US011254918B2

(12) United States Patent
Sonnenburg et al.

(10) Patent No.: US 11,254,918 B2
(45) Date of Patent: *Feb. 22, 2022

(54) COMPOSITIONS AND METHODS FOR MODULATING GROWTH OF A GENETICALLY MODIFIED GUT BACTERIAL CELL

(71) Applicants: The Board of Trustees of the Leland Stanford Junior University, Stanford, CA (US); Novome Biotechnologies, Inc., Daly City, CA (US)

(72) Inventors: Justin L. Sonnenburg, Redwood City, CA (US); Weston R. Whitaker, Daly City, CA (US); Elizabeth Stanley, Portola Valley, CA (US); William C. DeLoache, Oakland, CA (US)

(73) Assignees: The Board of Trustees of the Leland Stanford Junior University, Stanford, CA (US); Novome Biotechnolooies, Inc., Daly City, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/091,931

(22) Filed: Nov. 6, 2020

(65) Prior Publication Data

US 2021/0054356 A1 Feb. 25, 2021

Related U.S. Application Data

(63) Continuation of application No. 16/047,862, filed on Jul. 27, 2018, which is a continuation of application No. PCT/US2017/066408, filed on Dec. 14, 2017.

(60) Provisional application No. 62/435,048, filed on Dec. 15, 2016.

(51) Int. Cl.
| *C12N 9/24* | (2006.01) |
| *A61K 35/741* | (2015.01) |
| *C12N 15/52* | (2006.01) |
| *A61P 1/00* | (2006.01) |
| *C12N 15/74* | (2006.01) |
| *C12N 1/20* | (2006.01) |

(52) U.S. Cl.
CPC .......... *C12N 9/2402* (2013.01); *A61K 35/741* (2013.01); *A61P 1/00* (2018.01); *C12N 1/20* (2013.01); *C12N 15/52* (2013.01); *C12N 15/74* (2013.01); *C12Y 302/01178* (2013.01)

(58) Field of Classification Search
CPC .................................................. C12N 9/2402
See application file for complete search history.

(56) References Cited

U.S. PATENT DOCUMENTS

| 6,162,632 A | 12/2000 | Maloney et al. |
| 6,261,842 B1 | 7/2001 | Handelsman et al. |
| 6,610,529 B1 | 8/2003 | Curtiss, III et al. |
| 7,008,767 B2 | 3/2006 | Handelsman et al. |
| 7,101,565 B2 | 9/2006 | Monte |
| 7,238,853 B2 | 7/2007 | Kuvshinov et al. |
| 7,871,604 B1 | 1/2011 | Curtiss, III et al. |
| 7,981,651 B2 | 7/2011 | Klaenhammer et al. |
| 7,988,961 B2 | 8/2011 | Farrar et al. |
| 8,486,389 B2 | 7/2013 | Sidhu et al. |
| 8,529,887 B2 | 9/2013 | Schiffrin |
| 8,759,039 B2 | 6/2014 | Hehemann et al. |
| 8,927,252 B2 | 1/2015 | Iivadstrom et al. |
| 9,011,834 B1 | 4/2015 | Mckenzie et al. |
| 9,192,179 B2 | 11/2015 | Roughead et al. |
| 9,371,510 B2 | 6/2016 | Moore |
| 9,433,599 B2 | 9/2016 | Bar-Yoseph et al. |
| 9,487,764 B2 | 11/2016 | Falb et al. |
| 9,598,697 B2 | 3/2017 | Curtiss, III et al. |
| 9,610,307 B2 | 4/2017 | Berry et al. |
| 9,688,967 B2 | 6/2017 | Falb et al. |
| 10,058,574 B2 | 8/2018 | Grant et al. |
| 10,125,176 B2 | 11/2018 | Lindner et al. |
| 10,149,866 B2 | 12/2018 | Sidhu et al. |
| 2004/0025200 A1 | 2/2004 | Kuvshinov et al. |
| 2004/0096938 A1 | 5/2004 | Xu et al. |
| 2005/0276788 A1 | 12/2005 | Steidler et al. |
| 2009/0004148 A1 | 1/2009 | Kostantinov et al. |
| 2010/0076057 A1 | 3/2010 | Sontheimer et al. |
| 2010/0092440 A1 | 4/2010 | Strozzi et al. |
| 2013/0109098 A1 | 5/2013 | Allnutt et al. |
| 2015/0004705 A1 | 1/2015 | Lu et al. |
| 2015/0064138 A1 | 3/2015 | Lu et al. |
| 2015/0087055 A1 | 3/2015 | Sarpeshkar et al. |
| 2015/0265661 A1 | 9/2015 | Newberg et al. |

(Continued)

FOREIGN PATENT DOCUMENTS

| EP | 1841875 B1 | 10/2010 |
| EP | 2994537 A2 | 3/2016 |

(Continued)

OTHER PUBLICATIONS

Hehemann et. al. Bacteria of the human gut microbiome catabolize red seaweed glycans with carbohydrate-active enzyme updates from extrinsic microbes 2012. PNAS. 109(48): 19786-19791 (Year: 2012).*

(Continued)

*Primary Examiner* — Neil P Hammell
*Assistant Examiner* — Tiffany Nicole Grooms
(74) *Attorney, Agent, or Firm* — Kyle A. Gurley; Bozicevic, Field & Francis LLP

(57) ABSTRACT

Compositions and methods are provided for modulating growth of a genetically modified bacterial cell present in a human organ, for modulating growth of a genetically modified bacterial cell in an organ (e.g., gut), for displacing at least a portion of a population of bacterial cells in an organ, and for facilitating gut colonization by a genetically modified bacterial cell. Also provided are genetically modified bacterial cells, e.g., cells that include a heterologous carbohydrate-utilization gene or gene set that provides for the ability to utilize as a carbon source a rare carbohydrate of interest that is utilized as a carbon source by less than 50% of bacterial cells present in a human microbiome.

20 Claims, 21 Drawing Sheets

(3 of 21 Drawing Sheet(s) Filed in Color)

Specification includes a Sequence Listing.

(56) References Cited

U.S. PATENT DOCUMENTS

| | | | |
|---|---|---|---|
| 2016/0000837 A1* | 1/2016 | Rey | A61K 31/7088 424/93.2 |
| 2016/0030494 A1 | 2/2016 | Henn et al. | |
| 2016/0120915 A1 | 5/2016 | Blaser et al. | |
| 2016/0206666 A1 | 7/2016 | Falb et al. | |
| 2016/0208227 A1 | 7/2016 | Boeke et al. | |
| 2016/0271188 A1 | 9/2016 | Berry et al. | |
| 2016/0317414 A1 | 11/2016 | Stettler et al. | |
| 2016/0324766 A1 | 11/2016 | Stettler et al. | |
| 2016/0338924 A1 | 11/2016 | Stettler et al. | |
| 2016/0338932 A1 | 11/2016 | Stettler et al. | |
| 2017/0058282 A1 | 3/2017 | Lu et al. | |
| 2017/0065554 A1 | 3/2017 | Heiman et al. | |
| 2017/0067065 A1 | 3/2017 | Falb et al. | |
| 2017/0128499 A1 | 5/2017 | Falb et al. | |
| 2017/0145061 A1 | 5/2017 | Lu et al. | |
| 2017/0204401 A1 | 7/2017 | Brevnova et al. | |
| 2017/0273997 A1 | 9/2017 | Sakwinska et al. | |
| 2017/0306338 A1 | 10/2017 | Curtiss, III et al. | |
| 2018/0015130 A1 | 1/2018 | Berry et al. | |
| 2018/0155711 A1 | 6/2018 | Anderson et al. | |
| 2018/0280451 A9 | 10/2018 | Falb et al. | |
| 2018/0325963 A1 | 11/2018 | Isabella et al. | |

FOREIGN PATENT DOCUMENTS

| | | |
|---|---|---|
| EP | 3181682 A1 | 6/2017 |
| EP | 3213265 A1 | 9/2017 |
| WO | WO2011005756 A1 | 1/2011 |
| WO | WO2012108830 A1 | 8/2012 |
| WO | WO2014127351 A2 | 8/2014 |
| WO | WO2014145958 A2 | 9/2014 |
| WO | WO2014201037 A2 | 12/2014 |
| WO | WO2015003001 A1 | 1/2015 |
| WO | WO2015148680 A1 | 10/2015 |
| WO | WO2016026684 A1 | 2/2016 |
| WO | WO2016191757 A1 | 12/2016 |
| WO | WO2016201174 A2 | 12/2016 |
| WO | WO2016205394 A1 | 12/2016 |
| WO | WO2017035412 A1 | 3/2017 |
| WO | WO2017040719 A1 | 3/2017 |

OTHER PUBLICATIONS

Smith, Jeffrey. Electroporation Protocols for Microorganisms : Chapter 15: Genetic Transformation of *Bacteroides* spp. Using Electroporation. 1995, Methods in Molecular Biology. vol. 47. pp. 161-169 (Year: 1995).*

Farrar et. al. Engineering of the gut commensal bacterium Bacteroides ovatus to produce and secrete biologically active murine interleukin-2 in response to xylan. 2005. Journal of Applied Microbiology. 98, 1191-1197 (Year: 2005).*

Ostrov et. al. Design, synthesis, and testing toward a 57-codon genome. 2016. Science.353 (6301), 819-822 (Year: 2016).*

Kelly, Amelia G. A family of Integrative and Conjugative Elements (ICEs) involved in carbohydrate metabolism. 2013. University of Michigan (Year: 2013).*

Gen Bank Accession No. ABQC02000019.1 Aug. 15, 2012 (Year: 2012).*

Yang et. al. Xylooligosaccharide supplementation alters gut bacteria in both healthy and prediabetic adults: a pilot study. Frontiers in Physiology. 2015. vol. 6, Article 216, p. 1-11 (Year: 2015).*

Maldonado-Gomez et al. "Stable engraftment of Bifidobacterium longum AH1206 in the human gut depends on individualized features of the resident microbiome." Cell host & microbe, Oct. 12, 2016, pp. 515-526, vol. PO, Issue 4, Elsevier, New York City, NY.

Hehemann et. al. . "Bacteria of the human gut microbiome catabolize red seaweed glycans with carbohydrate-active enzyme updates from extrinsic microbes", Proceedings of the National Academy of Sciences, Nov. 27, 2012, pp. 19786-19791, 109 (48), National Academy of Sciences, Washington, DC.

Hehemann et al., Nature, "Transfer of carbohydrate-active enzymes from marine bacteria to Japanese gut microbiota", Nature, Apr. 8, 2010, pp. pp. 908-912, 464, Springer, Berlin, Germany.

Fukami, Tadashi, "Historical Contingency in Community Assembly: Integrating Niches, Species Pools, and Priority Effects", Annu. Rev. Evol. Syst. 2015 461-23.

Porphyranase Protein, WP_007560951. 1, retrieved from https:1/www.ncbi.nlm.nih.gov/protein/494834851?sat=17&satkey=32618018 on May 7, 2019 (Year: 2013).

Wu et al., Linking Long-term dietary patterns with gut microbial enterotypes, Science, vol. 334(6052, pp. 105-108 (Year: 2011).

Sonnenburg et al. "Specificity of polysaccharide use in intestinal bacteroides species determines diet-induced [microbiota alterations", Cell, Jun. 25, 2010, pp. 1241-1252, vol. 141, Issue 7, Elsevier, New York City, NY.

Shepherd, Elizabeth S. et al., "An exclusive metabolic niche enables strain engraftment in the gut microbiota", Nature, May 17, 2018, vol. 557, pp. 434-438.

Gomez et al., "Stable Engraftment of Bifidobacterium longum AH1206 in the Human Gut Depends on Individualized Features of the Resident Microbiome" Cell Host & Microbe, Oct. 12, 2016, 20, pp. 515-526.

Lam et al., "Intraspecies Competition for Niches in the Distal Gut Dictate Transmission during Persistent *Salmonella* Infection", PLOS, Dec. 2014, vol. 10, Issue 12, e1004527, pp. 1-21.

Lee et al., "Bacterial colonization factors control specificity and stability of the gut microbiota" Nature, Sep. 19, 2013, pp. 426-429.

Livanis et al., "Bacteroides fragilis type VI secretion systems use novel effector and immunity proteins to antagonize humangut *Bacteroidales* species" PNAS, Mar. 29, 2016, vol. 113, No. 13, pp. 3627-3632.

Reese et al., "Microbial nitrogen limitation in the mammalian large intestine", Nat Microbiol. Dec. 2018, 3(12), pp. 1441-1450.

Shepherd et al., "An exclusive metabolic niche enables strain engraftment in the gut microbiota", Nature, May 2018 ; 557(7705), pp. 434-438.

Sonnenburg et al., "Specificity of Polysaccharide Use in Intestinal Bacteroides Species Determines Diet-Induced Microbiota Alterations", Cell 141,Jun. 25, 2010, pp. 1241-1252.

Sorbara et al., "Interbacterial mechanisms of colonization resistance and the strategies pathogens use to overcome them", Mucosal Immunol, Jan. 2019, 12(1), pp. 1-9.

* cited by examiner

\* Higher abundance (P = 0.02)
and
Lower deviation (P < 0.01)

| No Por. | 0.4% Por. | Community | Location | Species |
|---|---|---|---|---|
| | | 1 | Site 1 (Palo Alto, CA) | Mus musculus |
| | | 2 | Site 1 (Palo Alto, CA) | Mus musculus |
| | | 3 | Site 2 (Palo Alto, CA) | Mus musculus |
| | | 4 | Site 2 (Palo Alto, CA) | Mus musculus |
| | | 5 | Site 3 (Daly City, CA) | Mus musculus |
| | | 6 | Site 3 (Daly City, CA) | Cavia porcellus |
| | | 7 | Site 3 (Daly City, CA) | Phodopus sungorus |
| | | 8 | Site 3 (Daly City, CA) | Chinchilla lanigera |

1% porphyran in drinking water

COMPOSITIONS AND METHODS FOR MODULATING GROWTH OF A GENETICALLY MODIFIED GUT BACTERIAL CELL

CROSS-REFERENCE

This application is a Continuation of U.S. application Ser. No. 16/047,862, filed Jul. 27, 2018, which is a Continuation of International Application No. PCT/US2017/066408, filed Dec. 14, 2017, which claims benefit of U.S. Provisional Patent Application No. 62/435,048, filed Dec. 15, 2016, which applications are incorporated herein by reference in their entirety.

GOVERNMENT RIGHTS

This invention was made with Government support under contracts DK085025 and OD006515 awarded by the National Institutes of Health and under contract 1648230 awarded by the National Science Foundation. The Government has certain rights in the invention.

INCORPORATION BY REFERENCE OF SEQUENCE LISTING PROVIDED AS A TEXT FILE

A Sequence Listing is provided herewith as a text file, "STAN-1357WO_SeqList_ST25.txt" created on Nov. 27, 2017 and having a size of 732 KB. The contents of the text file are incorporated by reference herein in their entirety.

INTRODUCTION

The gut microbiota is integral to many facets of human biology. Gut bacteria produce hundreds of metabolites that accumulate in human tissue, and the composition of the gut microbiota has been linked to pathogen susceptibility, immune disorders, heart disease, central nervous system diseases, diabetes and obesity. The rules governing gut ecology are largely unknown, and colonization level of an introduced bacterial strain could theoretically be influenced by a wide range of factors including competition for a variety of macro- and micro-nutrients and the avoidance of inhibitory interactions from other bacteria, bacteriophage and the immune system.

There is a need in the art for compositions and methods that facilitate the ability to colonize the gut of a patient with a desired bacterial strain, e.g., a strain that is predicted to improve the patient's health. Prior to this disclosure, it has not been possible to colonize the gut of a patient with an introduced bacterial strain such that the population of the introduced strain can reliably be maintained at a predictable colonization level, despite variations in diet, host genetics, and composition of the bacteria already present.

SUMMARY

Compositions and methods are provided for modulating growth of a genetically modified bacterial cell present in a human organ, for modulating growth of a genetically modified bacterial cell in an organ, for displacing at least a portion of a population of bacterial cells in an organ, and for facilitating gut colonization by a genetically modified bacterial cell.

For example, in some cases a subject method includes introducing to a human organ (e.g., gut) a genetically modified bacterial cell capable of controlled entrenchment and/or controlled colonization. In some cases a method of the disclosure includes administering to a human a rare carbohydrate of interest that is utilized as a carbon source by a subject genetically modified bacterial cell present in a human organ (e.g., gut), where less than 50% (e.g., less than 40%, less than 30%, less than 20%, less than 10%, less than 5%, less than 3%, less than 2%, less than 1%, less than 0.5%, less than 0.2%, less than 0.1%, or none; e.g., less than 30%, less than 10%, less than 3%, less than 1%, less than 0.3%, less than 0.1%, less than 0.03%, less than 0.01%, less than 0.003%, less than 0.001%, less than 0.0001%, or none) of other bacterial cells present in the organ utilize the rare carbohydrate of interest as a carbon source. In some cases a method of the disclosure includes introducing a subject genetically modified bacterial cell to an organ (e.g., gut) in vivo, wherein the genetically modified bacterial cell utilizes as a carbon source a rare carbohydrate of interest, where less than 50% (e.g., less than 40%, less than 30%, less than 20%, less than 10%, less than 5%, less than 3%, less than 2%, less than 1%, less than 0.5%, less than 0.2%, less than 0.1%, or none; e.g., less than 30%, less than 10%, less than 3%, less than 1%, less than 0.3%, less than 0.1%, less than 0.03%, less than 0.01%, less than 0.003%, less than 0.001%, less than 0.0001%, or none) of other bacterial cells present in the organ utilize the rare carbohydrate of interest as a carbon source. In some cases a method of the disclosure includes introducing to an organ (e.g., gut) a genetically modified bacterial cell capable of controlled entrenchment and/or controlled colonization, and displacing at least a portion of the population of bacterial cells in the organ with the genetically modified bacterial cell.

In some cases a method of the disclosure includes (a) introducing a genetically modified bacterial cell into a gut of an individual, where the genetically modified bacterial cell includes a heterologous carbohydrate-utilization gene or gene set that provides the genetically modified bacterial cell with the ability to use a carbohydrate of interest as a carbon source; and (b) administering the carbohydrate of interest to the individual, thereby providing the genetically modified bacterial cell with the carbon source.

Provided are genetically modified bacterial cells. In some embodiments such a cell utilizes as a carbon source a rare carbohydrate of interest that is utilized as a carbon source by less than 50% (e.g., less than 40%, less than 30%, less than 20%, less than 10%, less than 5%, less than 3%, less than 2%, less than 1%, less than 0.5%, less than 0.2%, less than 0.1%, or none; e.g., less than 30%, less than 10%, less than 3%, less than 1%, less than 0.3%, less than 0.1%, less than 0.03%, less than 0.01%, less than 0.003%, less than 0.001%, less than 0.0001%, or none) of bacterial cells present in a human microbiome (e.g., gut microbiome). In some cases, such a cell includes a heterologous carbohydrate-utilization gene or gene set that provides the genetically modified bacterial cell with an ability to utilize as a carbon source a rare carbohydrate of interest that is utilized as a carbon source by less than 50% (e.g., less than 40%, less than 30%, less than 20%, less than 10%, less than 5%, less than 3%, less than 2%, less than 1%, less than 0.5%, less than 0.2%, less than 0.1%, or none; e.g., less than 30%, less than 10%, less than 3%, less than 1%, less than 0.3%, less than 0.1%, less than 0.03%, less than 0.01%, less than 0.003%, less than 0.001%, less than 0.0001%, or none) of bacterial cells present in a human microbiome (e.g., gut microbiome). In some cases, a genetically modified bacterial cell includes (i) a heterologous therapeutic transgene; and (ii) a carbohydrate-utilization gene or gene set that provides the genetically modified bacterial cell with an ability to utilize as a carbon source a rare carbohydrate of interest that is utilized as a carbon source by less than 50% (e.g., less than 40%, less than 30%, less than 20%, less than 10%, less than 5%, less than 3%, less than 2%, less than 1%, less than 0.5%, less than 0.2%, less than 0.1%, or none; e.g., less than 30%, less than 10%, less than 3%, less than 1%, less than 0.3%, less than 0.1%, less than 0.03%, less than 0.01%, less than 0.003%, less than 0.001%, less than 0.0001%, or none) of bacterial cells present in a human microbiome (e.g., gut microbiome). In some cases, a genetically modified bacterial cell includes a heterologous carbohydrate-utilization gene or gene set that provides the genetically modified bacterial cell with the ability to use a rare carbohydrate of interest as a carbon source.

Provided are methods of genetically modifying a bacterial cell. In some such cases, a subject method includes (i) providing a bacterial cell; and (ii) genetically modifying the bacterial cell to utilize as a carbon source a rare carbohydrate of interest that is utilized as a carbon source by less than 50% (e.g., less than 40%, less than 30%, less than 20%, less than 10%, less than 5%, less than 3%, less than 2%, less than 1%, less than 0.5%, less than 0.2%, less than 0.1%, or none; e.g., less than 30%, less than 10%, less than 3%, less than 1%, less than 0.3%, less than 0.1%, less than 0.03%, less than 0.01%, less than 0.003%, less than 0.001%, less than 0.0001%, or none) of bacterial cells present in a human microbiome (e.g., gut microbiome). In some cases, a subject method includes (i) providing a bacterial cell that utilizes as a carbon source a rare carbohydrate of interest that is utilized as a carbon source by less than 50% (e.g., less than 40%, less than 30%, less than 20%, less than 10%, less than 5%, less than 3%, less than 2%, less than 1%, less than 0.5%, less than 0.2%, less than 0.1%, or none; e.g., less than 30%, less than 10%, less than 3%, less than 1%, less than 0.3%, less than 0.1%, less than 0.03%, less than 0.01%, less than 0.003%, less than 0.001%, less than 0.0001%, or none) of bacterial cells present in a human microbiome (e.g., gut microbiome); and (ii) genetically modifying the bacterial cell to express one or more therapeutic transgenes.

BRIEF DESCRIPTION OF THE DRAWINGS

The invention is best understood from the following detailed description when read in conjunction with the accompanying drawings. The patent or application file contains at least one drawing executed in color. Copies of this patent or patent application publication with color drawing(s) will be provided by the Office upon request and payment of the necessary fee. It is emphasized that, according to common practice, the various features of the drawings are not to-scale. On the contrary, the dimensions of the various features are arbitrarily expanded or reduced for clarity. Included in the drawings are the following figures.

(FIG. 2A) A strain of *Bacteroides ovatus* capable of utilizing porphyran (NB001) was isolated from the environment. (FIG. 2B) The porphyran utilizing strain reaches a higher (P=0.02) and more predictable (P<0.01) abundance in eight different complex communities in culture when porphyran is present. The average of two replicates for each community is shown. (FIG. 2C) Porphyran increased abundance of porphyran utilizer in vivo. Two groups of conventional mice, one fed a standard (std) diet and one fed a polysaccharide deficient (pd) diet, were colonized with porphyran utilizing *Bacteroides*, strain NB006. Porphyran was administered in the water, and abundance of both total anaerobic culturable bacteria and NB006 in the feces were monitored. Averages and standard deviation for replicates of four mice are shown. (FIG. 2D) Conventional mice being fed a standard diet (i.e. lacking porphyran) were administered a *Bacteroides* strain that cannot utilize porphyran, NB008. After seven days, these mice were challenged with NB006, a *Bacteroides* strain which can utilize porphyran. NB006 was cleared from the mice after five days. Abundance of NB008 and NB006 in the feces was monitored by selective plating, averages and standard deviation for replicates of three mice are shown. (FIG. 2E) Porphyran allowed for stable colonization of a porphyran utilizer into a resistant microbiota. Conventional mice were administered NB008, and one week later given porphyran in the water simultaneous to receiving NB006. Porphyran was removed from the water and then re-introduced, while abundances of both strains in the feces were monitored via selective plating. NB006 was able to displace NB008 with the addition of porphyran, and inhibit it from re-invasion on day 48. Averages and standard deviation for replicates of three mice are shown.

(FIG. 7A), Schematic of experimental design. Groups of mice with three different gut communities, mouse (RF), or human (Hum-1, Hum-2), were colonized with NB001. NB001 was tracked in feces for seven days, and mice were switched to specialized polysaccharide chow containing either inulin (in.) or porphyran (por.). (FIG. 7B), Density of NB001 in feces in the three gut communities over the course of seven days (n=10) Kruskal-Wallis test, p<0.0001. (FIG. 7C), Density of NB001 in feces prior to and upon addition of inulin in the diet (brackets/dotted lines, RF n=4, Hum-1 n=5) Kruskal-Wallis test, p=0.03. (FIG. 7D), Density in NB001 in feces prior to and upon addition of nori extract in the diet (brackets/dotted lines, RF n=5, Hum-1 n=7, Hum-2 n=6). Kruskal-Wallis test, p=0.19. Error bars indicate s.e.m.

(FIG. 8A), Mice colonized with PUL+ and fed a MAC-deficient diet or (FIG. 8B), MAC-rich diet demonstrated toggling of strain abundance upon administration of porphyran extract. (FIG. 8C), Mice colonized with PUL− and fed a MAC-rich diet showed no change in strain abundance with administration of porphyran extract. (panels FIG. 8D-FIG. 8F) Mice were colonized with PUL− for 6 days, and challenged with PUL+ on day 6. (FIG. 8D), PUL+ is excluded by PUL− in the absence of porphyran extract. (FIG. 8E), PUL+ displaces PUL− with access to porphyran for five days. (FIG. 8F), PUL+ and PUL− stably co-exist after a three day pulse of porphyran extract. Error bars indicate standard deviation, n=4 for all experiments.

(FIG. 9A), Schematic of porphyran PUL from NB001 aligned to the previously published *B. plebeius* PUL. Shown below are the different minimal PULs (Long, Medium, and Short) designed and tested for ability to confer growth on porphyran extract. The eight gene region deleted from NB001 PUL− is shown in gray ("Knockout"). (FIG. 9B), Growth curves for natural and engineered strains on porphyran extract as sole carbon source. (FIG. 9C), *B. thetaiotaomicron* harboring the medium length PUL colonized in conventional mice demonstrates toggling upon administration of 1% w/v porphryan extract in the drinking water (brackets/dotted lines, n=4). Error bars indicate standard deviation. (FIG. 9D), NB001 PUL+ colonized in conventional mice demonstrates tunable response to porphyran extract in the drinking water (brackets/dotted lines, n=4 per group). Error bars indicate standard deviation. (FIG. 9E), NB001 expressing GFP colonized in conventional mice given 0.01% porphryan extract (left) or 1% porphyran extract (right). Host epithelium visualized by DAPI (nuclei, blue), epithelial border visualized by phalloidin (F-actin, white), background microbiota by DAPI segmented from host epithelium (bacteria, magenta), NB001 by endogenous GFP (bacteria, green). Scale bar represents 20 μm.

(FIG. 10A), Principal Coordinates Analysis of weighted UniFrac distance for 16S rDNA amplicons from feces from the three background community groups from FIG. 7 before diet switch, conventional (RF), or humanized (Hum-1 and Hum-2), n=10. (FIG. 10B), Comparison of weighted UniFrac distances within each group (Intra) or across groups (A×B, A×C, B×C). One-way ANOVA, p<0.0001.

(FIG. 12A), Principal Coordinates Analysis (FIG. 12B), Unpaired two-tailed t-test, p=0.25

(FIG. 13A), Conventional mice (n=7) colonized with NB001 (PUL-1) containing an eight-gene deletion abrogating its ability to utilize porphyran (FIG. 9b) demonstrate resistance to subsequent challenge with an isogenic knockout strain (PUL-2) in the presence of 1% porphryan extract in the drinking water. Notably, conventionally raised mice were permissive to colonization by this strain and other species of *Bacteroides* tested (*B. thetaiotaomicron, B. fragilis, B. uniformis, B. vulgatus*, stable colonization range of 8*10e5–3*10e8 c.f.u. per ml feces), which differs from reports of tests on other conventionally raised mice, potentially reflecting intercolony microbiota differences. (FIG. 13B), Mice from FIG. 8e were challenged with the originally colonizing porphyran utilization knockout (PUL−) that was displaced by the utilizer (PUL+) and demonstrated colonization resistance to the previously displaced knockout strain.

DETAILED DESCRIPTION

Figure 1:
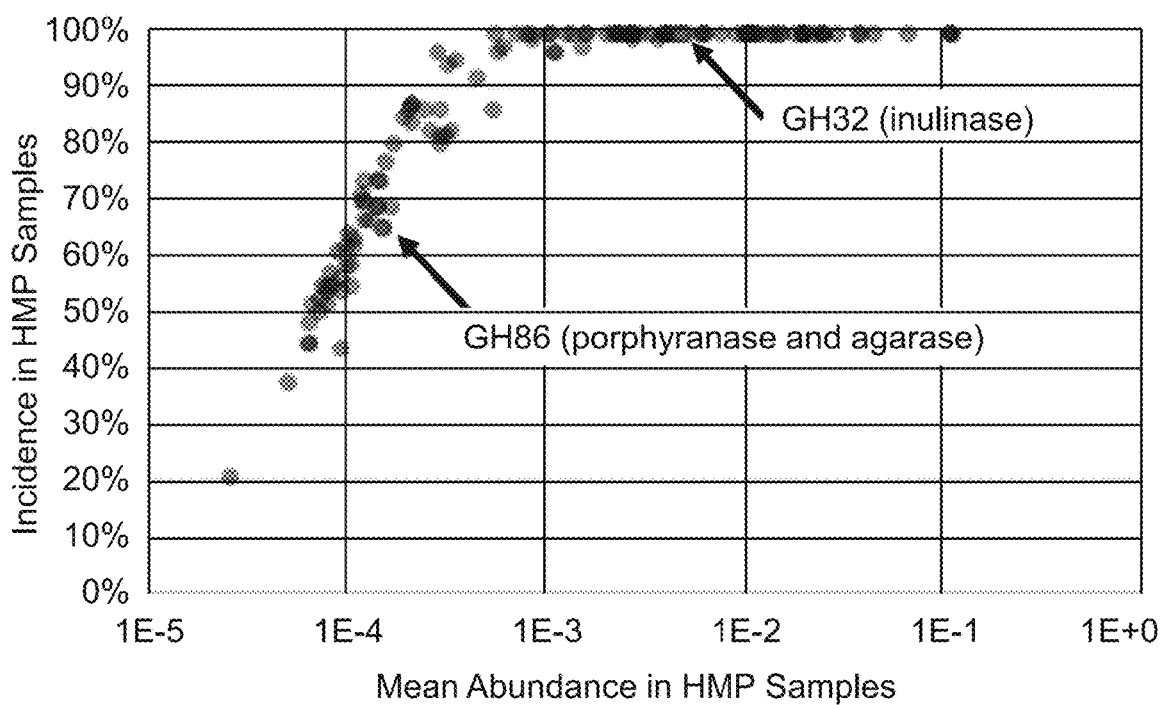
FIG. 1. Glycoside hydrolase representation in the healthy American microbiota. The incidence and mean abundance of glycoside hydrolase families in 87 Human Microbiome Project metagenomes are shown. The glycoside hydrolase family GH86 includes enzymes that can break down either porphyran or agarose, and is underrepresented in this these samples, with an incidence and mean abundance of 66% and 0.00015, respectively. GH32 is associated with utilization of inulin and is more highly represented with an incidence and mean abundance of 100% and 0.0049, respectively.
Figure 2A:
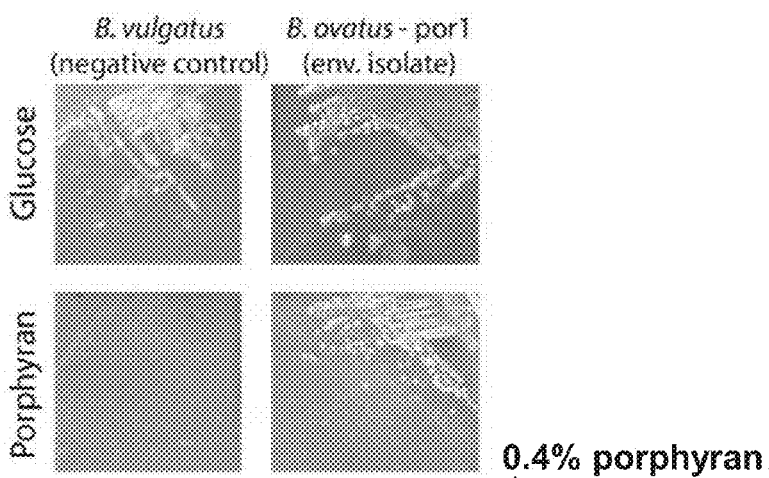
FIG. 2A-FIG. 2E. The abundance of porphyran-utilizing *Bacteroides* can be modulated by the addition of porphyran.
Figure 2B:
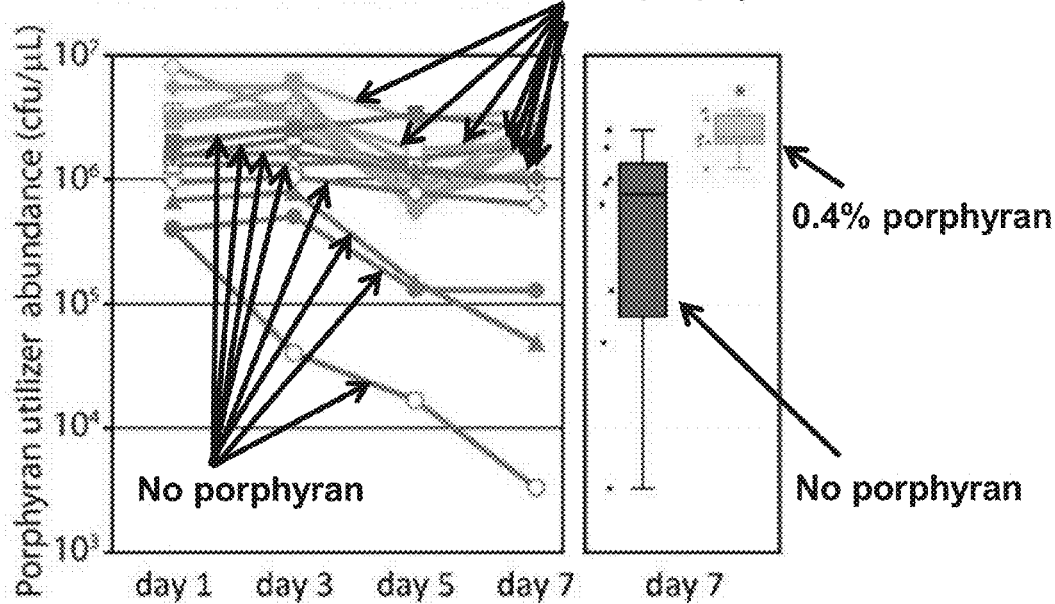
Figure 2C:
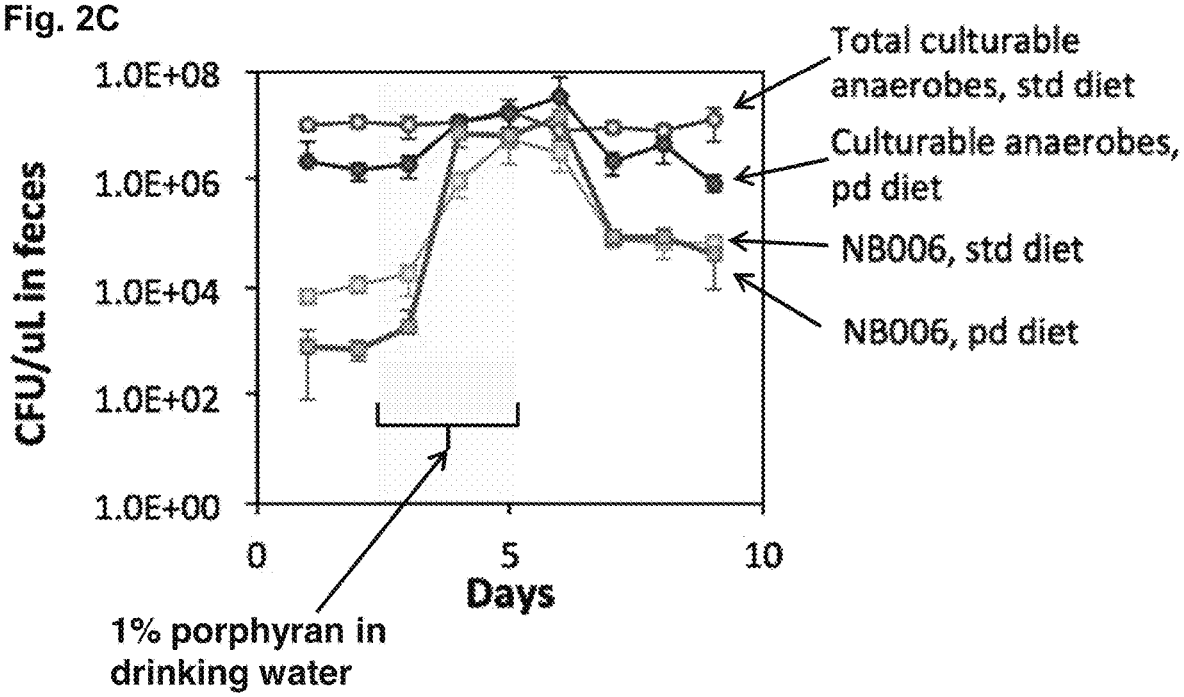
Figure 2D:
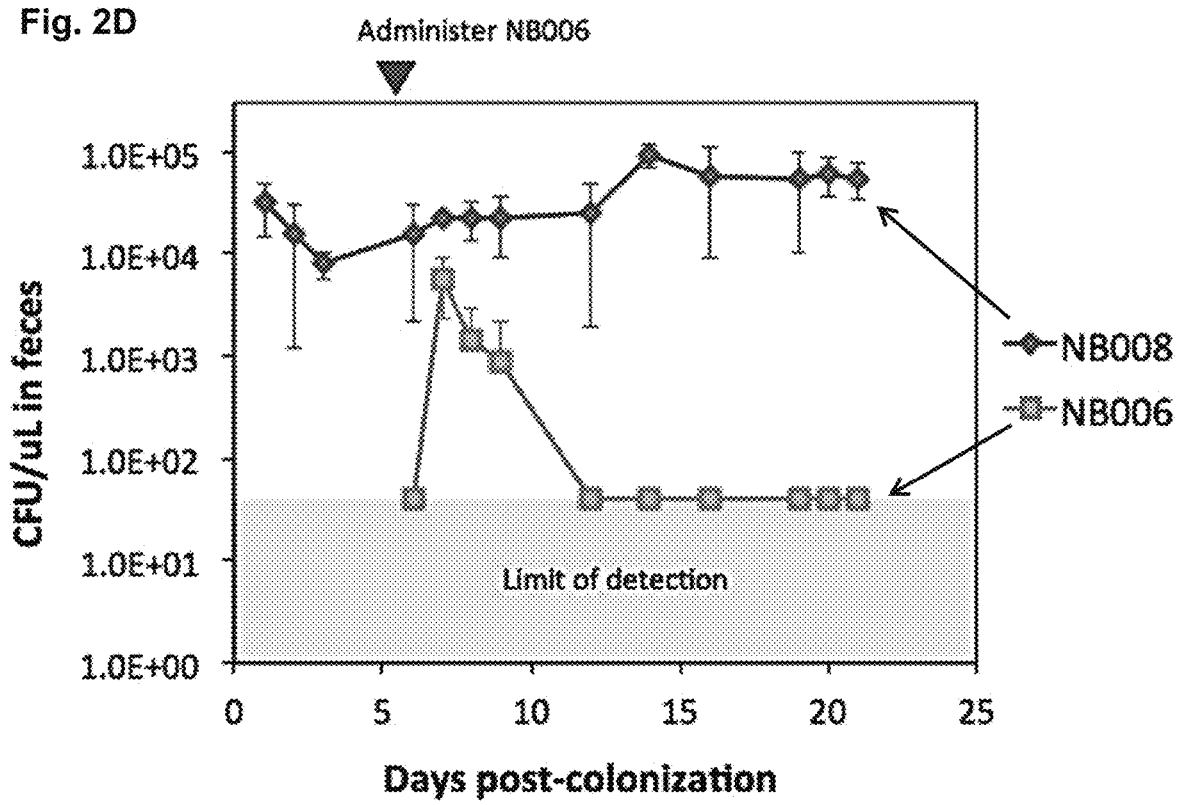
Figure 2E:
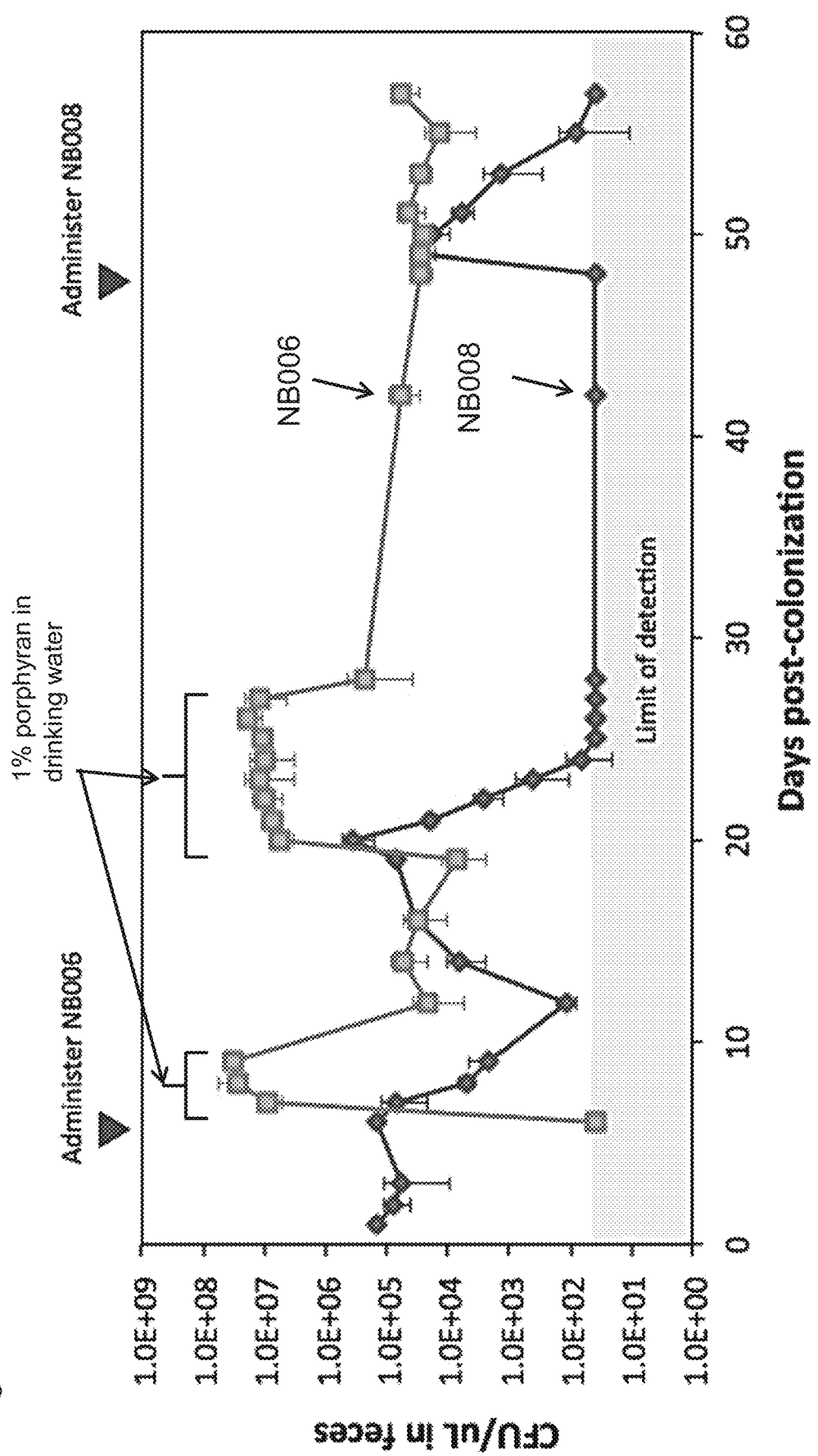

As summarized above, compositions and methods are provided for modulating growth of a genetically modified bacterial cell present in a human organ, for modulating growth of a genetically modified bacterial cell in an organ (e.g., gut), for displacing at least a portion of a population of bacterial cells in an organ, and for facilitating gut colonization by a genetically modified bacterial cell. Also provided are genetically modified bacterial cells, e.g., cells that include a heterologous carbohydrate-utilization gene or gene set that provides for the ability to utilize as a carbon source a rare carbohydrate of interest that is utilized as a carbon source by less than 50% of bacterial cells present in a human microbiome.

Before the present methods and compositions are described, it is to be understood that this invention is not limited to a particular method or composition described, and as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limits of that range is also specifically disclosed. Each smaller range between any stated value or intervening value in a stated range and any other stated or intervening value in that stated range is encompassed within the invention. The upper and lower limits of these smaller ranges may independently be included or excluded in the range, and each range where either, neither or both limits are included in the smaller ranges is also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can be used in the practice or testing of the present invention, some potential and preferred methods and materials are now described. All publications mentioned herein are incorporated herein by reference to disclose and describe the methods and/or materials in connection with which the publications are cited. It is understood that the present disclosure supercedes any disclosure of an incorporated publication to the extent there is a contradiction.

As will be apparent to those of skill in the art upon reading this disclosure, each of the individual embodiments described and illustrated herein has discrete components and features which may be readily separated from or combined with the features of any of the other several embodiments without departing from the scope or spirit of the present invention. Any recited method can be carried out in the order of events recited or in any other order which is logically possible.

It must be noted that as used herein and in the appended claims, the singular forms "a", "an", and "the" include plural referents unless the context clearly dictates otherwise. Thus, for example, reference to "a cell" includes a plurality of such cells (e.g., a population of such cells) and reference to "the protein" includes reference to one or more proteins and equivalents thereof, e.g. polypeptides, known to those skilled in the art, and so forth.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

Methods and Compositions

Provided are methods and compositions for modulating growth of a genetically modified bacterial cell present in an organ (e.g., human organ) of an individual. Modulation of growth can be achieved by administering an energy and/or carbon source (e.g., a nutrient, a carbohydrate, and the like) of interest to the individual, thereby providing the genetically modified bacterial cell with the energy and/or carbon source. The genetically modified bacterial cell can include a gene or gene set (e.g., a carbohydrate-utilization gene or gene set, e.g., in some cases a heterologous gene or gene set) that provides the genetically modified bacterial cell with the ability to use the energy and/or carbon source. As an example, in some cases a subject genetically modified bacterial cell includes a heterologous gene or gene set that provides the genetically modified bacterial cell with the ability to use a carbohydrate of interest as a carbon source.

In some cases a subject method includes a step of introducing the genetically modified bacterial into the organ (e.g., into a gut of an individual) prior to the modulating growth step. Thus, in some embodiments a genetically modified bacterial cell is introduced into an individual (e.g., into the individual's gut). The individual can be any mammalian species, e.g. rodent (e.g., mouse, rat), ungulate, cow, pig, sheep, camel, rabbit, horse, dog, cat, primate, non-human primate, human, etc. Thus, in some cases the individual is human. The individual may be a neonate, a juvenile, or an adult. In some cases, the introduction is by oral administration. Any convenient type of oral administration can be used. For example, oral administration can include delivery via eating (e.g., incorporated into food), drinking (e.g., incorporated into a solution such as drinking water), oral gavage (e.g., using a stomach tube), aerosol spray, tablets, capsules, pills, powders, and the like. In some embodiments, a genetically modified bacterial cell is introduced into an individual (e.g., into the individual's gut) by delivery into the individual's colon. Any convenient number of genetically modified cells can be introduced. For example, in some cases $10^3$ or more cells (e.g., $10^4$ or more, $10^5$ or more, $10^6$ or more, $10^7$ or more, $10^8$ or more cells, $10^9$ or more, or $10^{10}$ or more) cells are introduced. In some cases $10^{11}$ or more cells are introduced. In some cases, between $10^7$ and $10^{13}$ cells are introduced (e.g., between $10^8$-$10^{12}$, $10^9$-$10^{12}$, or $10^{10}$-$10^{12}$ cells).

i. Growth Control

Provided are methods for modulating growth of a genetically modified bacterial cell present in an organ (e.g., a gut) of an individual (e.g., a human). Growth can be controlled by providing (e.g., administering to the individual) a carbohydrate that can be utilized by the genetically modified bacterial cell as a carbon source. For example, growth can be controlled by adjusting the amount of carbohydrate provided and/or frequency with which the carbohydrate is provided.

In some cases, a privileged niche is created by using a carbon source (e.g., carbohydrate) that is uncommon in the diet of the individual and is either rarely or not consumed by the gut bacteria in the population of interest (e.g., human population of interest). The term 'privileged niche' is used herein to refer to a situation in which the genetically modified bacteria have 'privileged' access to a resource (e.g., a carbon source), which thereby provides them with a growth advantage (at least with respect to that resource). The use of a carbon source (e.g., a carbohydrate such as porphyran) to create a privileged niche for an introduced bacteria allows the bacteria to establish a population (e.g., colonize, entrench, etc.) in the target organ (e.g., gut). Moreover, because the introduced bacteria has privileged access, the amount of the carbon source (e.g., carbohydrate) that is made available to the introduced bacteria can be manipulated (e.g., increased, decreased, or maintained) to control the growth of the population of introduced bacteria (e.g., in some cases without perturbing resident bacterial populations). In some embodiments, this results in a situation in which the abundance of introduced bacteria at any given time is predictable, e.g., based on the amount of privileged resource (e.g., carbohydrate such as porphyran) that is being provided (e.g., introduced into the diet of the individual) (see, e.g., FIG. 2, panel B). For example, in some cases the deviation in abundance of the introduced bacteria between different microbial communities by the $7^{th}$ day after introduction (or $7^{th}$ day after introduction, where the introduced bacteria had access to the privileged resource) spans a range of 4-fold or less (e.g., 3-fold or less).

In some embodiments, e.g., to provide a privileged niche to the introduced genetically modified bacteria, the carbohydrate of interest is a rare carbohydrate of interest. By 'rare' carbohydrate of interest, it is meant a carbohydrate of interest that is utilized by less than 50% (e.g., less than 40%, less than 30%, less than 20%, less than 10%, less than 5%, less than 3%, less than 2%, less than 1%, less than 0.5%, less than 0.2%, less than 0.1%, or none; e.g., less than 30%, less than 10%, less than 3%, less than 1%, less than 0.3%, less than 0.1%, less than 0.03%, less than 0.01%, less than 0.003%, less than 0.001%, less than 0.0001%, or none) of other bacterial cells present in a target organ such as the gut (i.e., cells 'other' than the introduced/genetically modified bacteria, e.g., cells of the resident population prior to introduction). Thus, in some cases (e.g., in any of the methods of the disclosure), a rare carbohydrate of interest is one that can be utilized by less than 50% (e.g., less than 40%, less than 30%, less than 20%, less than 10%, less than 5%, less than 3%, less than 2%, less than 1%, less than 0.5%, less than 0.2%, less than 0.1%, or none; e.g., less than 30%, less than 10%, less than 3%, less than 1%, less than 0.3%, less than 0.1%, less than 0.03%, less than 0.01%, less than 0.003%, less than 0.001%, less than 0.0001%, or none) of other bacterial cells present in the organ. In some cases (e.g., in any of the methods of the disclosure), the rare carbohydrate of interest is one that can be utilized by less than 20% (e.g., less than 10%, less than 5%, less than 3%, less than 2%, less than 1%, less than 0.5%, less than 0.2%, less than 0.1%, or none) of other bacterial cells present in the organ. In some cases (e.g., in any of the methods of the disclosure), the rare carbohydrate of interest is one that can be utilized by less than 5% (e.g., less than 3%, less than 2%, less than 1%, less than 0.5%, less than 0.2%, less than 0.1%, or none) of other bacterial cells present in the organ. In some cases (e.g., in any of the methods of the disclosure), the rare carbohydrate of interest is one that can be utilized by less than 2% (e.g., less than 1%, less than 0.5%, less than 0.2%, less than 0.1%, or none) of other bacterial cells present in the organ. In some cases (e.g., in any of the methods of the disclosure), the rare carbohydrate of interest is one that can be utilized by less than 0.5% (e.g., less than 0.2%, less than 0.1%, or none) of other bacterial cells present in the organ. In some cases (e.g., in any of the methods of the disclosure), the rare carbohydrate of interest is one that can be utilized by none of the other bacterial cells present in the organ.

A method of the disclosure can include a step of administering to an individual (e.g., a human) a carbohydrate of interest (e.g., a rare carbohydrate of interest) that is utilized as a carbon source by a subject genetically modified bacterial cell present in an organ of the individual (e.g., the gut), wherein less than 50% (e.g., less than 40%, less than 30%, less than 20%, less than 10%, less than 5%, less than 3%, less than 2%, less than 1%, less than 0.5%, less than 0.2%, less than 0.1%, or none; e.g., less than 30%, less than 10%, less than 3%, less than 1%, less than 0.3%, less than 0.1%, less than 0.03%, less than 0.01%, less than 0.003%, less than 0.001%, less than 0.0001%, or none) of other bacterial cells present in the organ utilize the rare carbohydrate of interest as a carbon source. In some cases, such a method includes a step of introducing the genetically modified bacterial cell into the organ of the individual, e.g., prior to administering the carbohydrate of interest. In some embodiments, the organ (e.g., gut) of the individual includes at least 5 other bacterial species (other than the genetically modified bacteria), e.g., at least 8, at least 10, at least 15, at least 20, at least 50, at least 100, at least 200, at least 500, or at least 1,000 other bacterial species. In some cases, the organ (e.g., gut) of the individual includes at least 50 other bacterial species (other than the genetically modified bacteria). In some cases, the organ (e.g., gut) of the individual includes at least 100 other bacterial species (other than the genetically modified bacteria).

In some cases, two or more privileged niches (e.g., in some cases using dietary substrates from distinct geographic regions) can be used, e.g., to increase the effectiveness of this strategy even further. For example, this may allow robust colonization in the event that one of the two rare substrates is utilized by an individual's endogenous microbiota.

ii. Colonization and Entrenchment

In some cases, growth modulation is used to allow a bacterial cell (e.g., population of bacterial cells) to colonize a target organ (e.g., gut). Thus, provided are methods that facilitate colonization of a bacterial cell (e.g., a population of bacterial cells) in an organ (e.g., gut) of an individual. By "colonize" it is meant that an introduced bacterial cell (e.g., population of bacterial cells) can establish a population of a desired abundance or level or can establish a large enough population in the target organ that the population is detectable, despite the presence of already established bacterial populations. In some cases, the introduced bacteria reaches a 'high level' of colonization (i.e., a 'high abundance'). In such cases, the introduced bacteria reaches an abundance of $10^5$ CFU/μl or more (e.g., $10^6$ CFU/μl or more, $10^7$ CFU/μl or more) (e.g., by day 6 after introduction) (e.g., in the target organ). Thus, in some cases, an introduced bacteria reaches an abundance of $10^7$ CFU/μl or more. In some cases, the introduced bacteria reaches a 'low level' of colonization (i.e., a 'low abundance'), but the population is still detectable (e.g., by day 6 after introduction). For example, in some cases, the introduced bacteria reaches an abundance in a range of from $10^2$ CFU/μl to $10^4$ CFU/μl (e.g., $10^2$ CFU/μl, $10^3$ CFU/μl, $10^4$ CFU/μl) (e.g., by day 6 after introduction) (e.g., in the target organ).

In some embodiments, the introduced/genetically modified bacteria reaches an abundance such that it attains a population level of 10% or more (e.g., 20% or more, 30% or more, 40% or more, 50% or more, 60% or more, 70% or more, 80% or more, or 90% or more) of total anaerobic CFUs (see e.g., FIG. 2) (e.g., by day 6 after introduction) (e.g., in the target organ). In some embodiments, the introduced bacteria reaches an abundance such the population attains a population level in a range of from 10%-90% (e.g., from 10%-80%, 10%-70%, 10%-60%, 10%-50%, 20%-90%, 20%-80%, 20%-70%, 20%-60%, 20%-50%, 30%-90%, 30%-80%, 30%-70%, 30%-60%, or 30%-50%) of total anaerobic CFUs (e.g., by day 6 after introduction) (e.g., in the target organ).

In some embodiments, the introduced/genetically modified bacteria reaches an abundance such that it attains a population level of 1% or more (e.g., 2% or more, 5% or more, or 10% or more) of total bacterial cells in the organ (e.g., gut). In some embodiments, the introduced/genetically modified bacteria reaches an abundance such that it attains a population level in a range of from 1%-50% of total bacterial cells in the organ (e.g., from 1%-40%, 1%-30%, 1%-20%, 1%-15%, 2%-50%, 2%-40%, 2%-30%, 2%-20%, 2%-15%, 5%-50%, 5%-40%, 5%-30%, 5%-20%, or 5%-15% of total bacterial cells in the organ).

In some cases at least a portion of the population of bacterial cells in an organ (e.g., gut) is displaced as a result of modulating the growth (e.g., by administration of a carbohydrate of interest) of the genetically modified bacterial cell. For example, in some cases 5% or more (e.g., 10% or more, 15% or more, or 20% or more) of the population of bacterial cells in an organ (e.g., gut) is displaced as a result of modulating the growth (e.g., by administration of a carbohydrate of interest) of the genetically modified bacterial cell. In some cases, the genetically modified bacterial cell and the bacterial cells in the population of bacterial cells are the same species. In some cases, the genetically modified bacterial cell and the bacterial cells in the population of bacterial cells are different species. In some cases, the genetically modified bacterial cell is generated by providing a bacterial cell from the population of bacterial cells and removing or inactivating one or more genes in the bacterial cell.

In some embodiments, colonization is stable for a long period of time. Thus, in some cases a genetically modified bacterial cell of the disclosure becomes entrenched in the gut. The term "entrench" (e.g., "entrenchment") is used herein to refer to a situation in which an introduced species becomes a stable/persistent member of the community into which it was introduced. For example, in some cases when entrenchment is not accomplished, an introduced bacterial species (e.g., introduced into the gut of an individual) might be cleared (reduced to undetectable levels) by approximately one week after introduction. If there is not a niche available to the introduced bacteria, it must compete with species that are already established (entrenched), and that share the same niche with the introduced bacteria (i.e., the introduced bacteria would have to compete for resources with already established species).

In some cases, entrenchment is accomplished when an introduced bacteria (e.g., a wild type species not normally present in the target organ, e.g., gut; a genetically modified bacterial cell; and the like) remains detectable or at a desired abundance or population level in the organ into which it was introduced (e.g., on day 6 after introduction). In other words, in some cases an introduced bacteria is entrenched if it remains detectable or at a desired abundance or population level for 6 or more days (e.g., 7 or more, 8 or more, 9 or more, or 10 or more) days after introduction. By detectable it is meant that the population of introduced bacteria includes a large enough number of individuals that their presence is detectable. In some cases, entrenchment is maintained by providing a sufficient amount of a carbohydrate (e.g., rare carbohydrate of interest) that can be utilized by the genetically modified bacterial cell at a sufficient frequency. In some cases, entrenchment can be maintained in the absence of a carbohydrate (e.g., rare carbohydrate of interest) that can be utilized by the genetically modified bacterial cell.

For any of the above metrics (e.g., abundance level, abundance range, population level, and the like), a time frame can be placed on the metric. For example, in some cases the metric is reached within 5 days of introduction of the bacteria. In some case, the metric is reached within 6 days of introduction of the bacteria. In some case, the metric is reached within 7 days of introduction of the bacteria. However, the time frame need not be relative to introduction of the bacteria. For example, in some cases the metric is relative to the introduction of the resource (e.g., carbohydrate of interest, rare carbohydrate of interest such as porphyran). Thus, in some cases the metric is reached within 5 days of introduction of the resource (e.g., carbohydrate of interest, rare carbohydrate of interest such as porphyran). In some case, some cases the metric is reached within 6 days of introduction of the resource (e.g., carbohydrate of interest, rare carbohydrate of interest such as porphyran). In some case, the metric is reached within 7 days of introduction of the resource (e.g., carbohydrate of interest, rare carbohydrate of interest such as porphyran).

In some embodiments a method of the disclosure includes a step of detecting the presence of (e.g., measure the abundance of) the genetically modified bacterial cell after it has been introduced into an individual (e.g., 3 days, 4 days, 5 days, 6 days, and/or 7 days after introduction; and/or 3 days, 4 days, 5 days, 6 days, and/or 7 days after providing the carbohydrate of interest). In some such cases, the step of detecting includes measuring the colony forming units (e.g., CFU/µl) of the genetically modified bacterial cell present in the organ (e.g., gut) of the individual. In some such cases the detecting further includes measuring the colony forming units (e.g., CFU/µl) of other bacteria present in the organ.

In some cases, the term "controlled" is used in front of "colonization" and/or "entrenchment" (e.g., "controlled colonization"; "controlled entrenchment"). The term "controlled" is used as such to refer to a situation in which the colonization and/or entrenchment of a bacteria is controllable by a user. For example, if the growth and/or survival of a given bacterial cell (e.g., a genetically modified bacterial cell) can be modulated by administering an energy and/or carbon source (e.g., carbohydrate of interest) to a host (e.g., a human) and/or a host organ, then the colonization and/or entrenchment of the bacterial is controllable. For example, in such a situation the population size and/or duration of colonization can depend on the amount and/or frequency with which the energy and/or carbon source (e.g., carbohydrate) is administered.

iii. Carbohydrate of Interest

In some embodiments the carbohydrate of interest (e.g., rare carbohydrate of interest) is a polysaccharide. In some cases the carbohydrate of interest (e.g., rare carbohydrate of interest) is a sulfated carbohydrate. In some cases the carbohydrate of interest (e.g., rare carbohydrate of interest) is selected from the group consisting of porphyran, agarose, carrageenan, and any combination thereof. In some cases the carbohydrate of interest (e.g., rare carbohydrate of interest) is a carbohydrate cleaved by a glycoside hydrolase belonging to glycoside hydrolase family GH86. In some cases the carbohydrate of interest (e.g., rare carbohydrate of interest) is a marine carbohydrate. Examples of marine carbohydrates include but are not limited to: porphyran, agarose, agaropectin, carrageenan, and marine microbe exopolysaccharides. In some cases the carbohydrate of interest (e.g., rare carbohydrate of interest) is selected from porphyran and agarose. In some cases the carbohydrate of interest (e.g., rare carbohydrate of interest) is porphyran. In some cases the carbohydrate of interest (e.g., rare carbohydrate of interest) is agarose.

In some cases the carbohydrate of interest (e.g., rare carbohydrate of interest) is a carbohydrate that contains a glycosidic linkage selected from the group consisting of β-d-galactopyranose to α-l-galactopyranose-6-sulphate, β-d-galactopyranose to 3,6-anhydro-α-l-galactopyranose.

In some cases the carbohydrate of interest (e.g., rare carbohydrate of interest) is a sulfated polygalactan. In some such cases, one or more of the galactose residues of the sulfated polygalactan can be a 3,6-anhydro-galactose (e.g., in some cases joined by alternating α-1,3 and β-1,4-glycosidic linkage). In some cases, one or more of the galactopyranose residues of the sulfated polygalactan can be modified by one or more ester sulfates. In some cases, one or more of the galactose residues of the sulfated polygalactan is a 3,6-anhydro-galactose (e.g., in some cases joined by alternating α-1,3 and β-1,4-glycosidic linkage); and one or more of the galactopyranose residues of the sulfated polygalactan is modified by one or more ester sulfates.

In some cases, the carbohydrate of interest is administered to an individual and in some such cases the carbohydrate of interest is isolated. The term "isolated" refers to the state in which a molecule (e.g., a carbohydrate) can be. In such a case, the carbohydrate will be free or substantially free of material with which it is naturally associated such as other carbohydrates with which it is found in the natural environment, or the environment in which it is prepared.

In some cases, less than 50% (e.g., less than 40%, less than 30%, less than 20%, less than 10%, less than 5%, less than 3%, less than 2%, less than 1%, less than 0.5%, less than 0.2%, less than 0.1%, or none; e.g., less than 30%, less than 10%, less than 3%, less than 1%, less than 0.3%, less than 0.1%, less than 0.03%, less than 0.01%, less than 0.003%, less than 0.001%, less than 0.0001%, or none) of other bacterial cells present in the organ utilize the carbohydrate of interest (e.g., rare carbohydrate of interest) as a carbon source. In some cases, the carbohydrate of interest (e.g., rare carbohydrate of interest) cannot be utilized or digested by mammalian (e.g., human) cells.

In some cases, the carbohydrate of interest is administered at a sufficient frequency and/or at a sufficient amount for controlled colonization and/or controlled entrenchment. For example, the carbohydrate of interest can be administered 1, 2, 3, 4, 5, 6, or more times per day, week, month, or year. The carbohydrate of interest can be administered over a period of 1, 2, 3, 4, 5, 6, 7, 8, 9, 10, or more days, weeks, months, or years. In some cases, the carbohydrate of interest can be administered by oral administration. Any convenient type of oral administration can be used. For example, oral administration can include delivery via eating (e.g., incorporated into food), drinking (e.g., incorporated into a solution such as drinking water), oral gavage (e.g., using a stomach tube), aerosol spray, tablets, capsules, pills, powders, and the like.

iv. Genetically Modified Bacteria

In some cases a genetically modified bacterial cell includes a heterologous carbohydrate-utilization gene or gene set. "Heterologous," as used herein, means a nucleic acid and/or polypeptide that is not found in the native bacteria. For example, in a case where a bacterial cell includes a gene set (e.g., a nucleic acid encoding a set of proteins) that provides the cell with the ability to utilize a carbon source that the cell otherwise cannot use, and where that gene set is not naturally found in that bacteria, the gene set is 'heterologous' to the bacterial cell.

In some cases a subject method is a method of genetically modifying a bacterial cell to utilize as a carbon source a rare carbohydrate of interest. Any convenient method can be used to introduce a nucleic acid into a prokaryotic cell, e.g., by electroporation (e.g., using electro-competent cells), by conjugation, by chemical methods (e.g., using chemically competent cells), and the like.

In some embodiments, a genetically modified bacterial cell utilizes as a carbon source a rare carbohydrate of interest (as described elsewhere herein, e.g., wherein less than 50% of other bacterial cells present in the organ utilize the rare carbohydrate of interest as a carbon source). This is due to the fact that a subject genetically modified bacterial cell includes a carbohydrate-utilization gene or gene set that provides the genetically modified bacterial cell with the ability to use a carbohydrate of interest as a carbon source. In some cases, the carbohydrate-utilization gene or gene set is native to the cell. In some case, the carbohydrate-utilization gene or gene set is heterologous to the cell (e.g., can be from a different species of bacteria). Thus, in some cases, the carbohydrate of interest cannot be utilized as a carbon source by the genetically modified bacterial cell in the absence of a heterologous carbohydrate-utilization gene or gene set. In some cases, the genetically modified bacterial cell is capable of utilizing the carbohydrate of interest as a carbon source in the absence of a heterologous carbohydrate-utilization gene or gene set, but the presence of the heterologous carbohydrate-utilization gene or gene set enhances that capability.

In some cases, a carbohydrate-utilization gene or gene set includes a porphyranase (e.g., one from GH family 86 (GH86)). In some cases, a carbohydrate-utilization gene or gene set includes an agarase (e.g., one from GH family 86 (GH86)).

In some cases, a subject carbohydrate-utilization gene or gene set includes one or more nucleic acids encoding BACPLE_1683-1706 from the B. plebeius genome (or homologs thereof) (see, e.g., Table 6). In some cases, a subject carbohydrate-utilization gene or gene set includes one or more nucleic acids encoding BACPLE_1683-1687 from the B. plebeius genome (or homologs thereof). In some cases, a subject carbohydrate-utilization gene or gene set includes one or more nucleic acids encoding BACPLE_1700-1706 from the B. plebeius genome (or homologs thereof). In some cases, a subject carbohydrate-utilization gene or gene set includes one or more nucleic acids encoding BACPLE_1683-1687 from the B. plebeius genome (or homologs thereof) and BACPLE_1700-1706 from the B. plebeius genome (or homologs thereof). In some cases, a subject carbohydrate-utilization gene or gene set includes one or more nucleic acids encoding BACPLE_1683-1699 from the B. plebeius genome (or homologs thereof). In some cases, a subject carbohydrate-utilization gene or gene set includes one or more nucleic acids encoding BACPLE_1688-1706 from the B. plebeius genome (or homologs thereof). In some cases, a subject carbohydrate-utilization gene or gene set includes one or more nucleic acids encoding BACPLE_1683-1687 from the B. plebeius genome (or homologs thereof) as well as both porphyranases from within BACPLE_1688-1699 from the B. plebeius genome (or homologs thereof). In some cases, a subject carbohydrate-utilization gene or gene set includes one or more nucleic acids encoding BACPLE_1700-1706 from the B. plebeius genome (or homologs thereof) as well as both porphyranases from within BACPLE_1688-1699 from the B. plebeius genome (or homologs thereof). In some cases, a subject carbohydrate-utilization gene or gene set includes one or more nucleic acids encoding BACPLE_1683-1687 and BACPLE_1700-1706 from the B. plebeius genome (or homologs thereof) as well as both porphyranases from within BACPLE_1688-1699 from the B. plebeius genome (or homologs thereof).

As such, in some cases, a subject carbohydrate-utilization gene or gene set includes one or more nucleic acids encoding proteins that have 80% or more sequence identity (e.g., 85% or more, 90% or more, 95% or more, or 100% sequence identity) with BACPLE_1683-1706 from the B. plebeius genome (see, e.g., Table 6). In some cases, a subject carbohydrate-utilization gene or gene set includes one or more nucleic acids encoding proteins that have 80% or more sequence identity (e.g., 85% or more, 90% or more, 95% or more, or 100% sequence identity) with BACPLE_1683-1687 from the B. plebeius genome. In some cases, a subject carbohydrate-utilization gene or gene set includes one or more nucleic acids encoding proteins that have 80% or more sequence identity (e.g., 85% or more, 90% or more, 95% or more, or 100% sequence identity) with BACPLE_1700-1706 from the B. plebeius genome. In some cases, a subject carbohydrate-utilization gene or gene set includes one or more nucleic acids encoding proteins that have 80% or more sequence identity (e.g., 85% or more, 90% or more, 95% or more, or 100% sequence identity) with BACPLE_1683-1687 from the B. plebeius genome (or homologs thereof) and BACPLE_1700-1706 from the B. plebeius genome. In some cases, a subject carbohydrate-utilization gene or gene set includes one or more nucleic acids encoding proteins that have 80% or more sequence identity (e.g., 85% or more, 90% or more, 95% or more, or 100% sequence identity) with BACPLE_1683-1699 from the B. plebeius genome. In some cases, a subject carbohydrate-utilization gene or gene set includes one or more nucleic acids encoding proteins that have 80% or more sequence identity (e.g., 85% or more, 90% or more, 95% or more, or 100% sequence identity) with BACPLE_1688-1706 from the *B. plebeius* genome. In some cases, a subject carbohydrate-utilization gene or gene set includes one or more nucleic acids encoding proteins that have 80% or more sequence identity (e.g., 85% or more, 90% or more, 95% or more, or 100% sequence identity) with BACPLE_1683-1687 from the *B. plebeius* genome (or homologs thereof) as well as both porphyranases from within BACPLE_1688-1699 from the *B. plebeius* genome. In some cases, a subject carbohydrate-utilization gene or gene set includes one or more nucleic acids encoding proteins that have 80% or more sequence identity (e.g., 85% or more, 90% or more, 95% or more, or 100% sequence identity) with BACPLE_1700-1706 from the *B. plebeius* genome (or homologs thereof) as well as both porphyranases from within BACPLE_1688-1699 from the *B. plebeius* genome. In some cases, a subject carbohydrate-utilization gene or gene set includes one or more nucleic acids encoding proteins that have 80% or more sequence identity (e.g., 85% or more, 90% or more, 95% or more, or 100% sequence identity) with BACPLE_1683-1687 and BACPLE_1700-1706 from the *B. plebeius* genome (or homologs thereof) as well as both porphyranases from within BACPLE_1688-1699 from the *B. plebeius* genome.

TABLE 6

SEQ ID NOs. and annotations for proteins encoded by *B. plebius* genome (BACPLE_1669-1706).

| B. Plebeius Homolog ID | SEQ ID NO | Annotation |
|---|---|---|
| BACPLE_01669 | 1 | histidine kinase CDS |
| BACPLE_01670 | 2 | beta-agarase CDS |
| BACPLE_01671 | 3 | glycosyhydrolase CDS |
| BACPLE_01672 | 4 | threonine synthase CDS |
| BACPLE_01673 | 5 | hypothetical protein CDS |
| BACPLE_01674 | 6 | altronate hydrolase CDS |
| BACPLE_01675 | 7 | altronate oxidoreductase CDS |
| BACPLE_01676 | 8 | sorbitol dehydrogenase CDS |
| BACPLE_01677 | 9 | L-fucose: H+ symporter permease CDS |
| BACPLE_01678 | 10 | amidohydrolase CDS |
| BACPLE_01679 | 11 | aldo/keto reductase CDS |
| BACPLE_01680 | 12 | hypothetical protein CDS |
| BACPLE_01682 | 13 | hypothetical protein CDS |
| BACPLE_01683 | 14 | hypothetical protein CDS |
| BACPLE_01684 | 15 | glycosyhydrolase CDS |
| BACPLE_01685 | 16 | hypothetical protein CDS |
| BACPLE_01686 | 17 | hypothetical protein CDS |
| BACPLE_01688 | 18 | hypothetical protein CDS |
| BACPLE_01689 | 19 | beta-porphyranase B CDS |
| BACPLE_01692 | 20 | hypothetical protein CDS |
| BACPLE_01693 | 21 | beta-porphyranase A CDS |
| BACPLE_01694 | 22 | hypothetical protein CDS |
| BACPLE_01695 | 23 | hypothetical protein CDS |
| BACPLE_01696 | 24 | hypothetical protein CDS |
| BACPLE_01697 | 25 | hypothetical protein CDS |
| BACPLE_01698 | 26 | SusC/RagA family TonB-linked outer membrane protein CDS |
| BACPLE_01699 | 27 | hybrid two component system |
| BACPLE_01700 | 28 | alcohol dehydrogenase CDS |
| BACPLE_01701 | 29 | acetylglucosamine-6-sulfatase CDS |
| BACPLE_01702 | 30 | hypothetical protein CDS |
| BACPLE_01703 | 31 | glycoside hydrolase CDS |
| BACPLE_01704 | 32 | hypothetical protein CDS |
| BACPLE_01705 | 33 | hypothetical protein CDS |
| BACPLE_01706 | 34 | beta-galactosidase CDS |

In some cases, a subject carbohydrate-utilization gene or gene set includes one or more nucleic acids encoding SEQ ID NOs.: 14-34 (or homologs thereof) (see, e.g., Table 6). In some cases, a subject carbohydrate-utilization gene or gene set includes one or more nucleic acids encoding SEQ ID NOS.: 14-17 (or homologs thereof). In some cases, a subject carbohydrate-utilization gene or gene set includes one or more nucleic acids encoding SEQ ID NOS.: 28-34 (or homologs thereof). In some cases, a subject carbohydrate-utilization gene or gene set includes one or more nucleic acids encoding SEQ ID NOS.: 14-17 (or homologs thereof) and SEQ ID NOS.: 28-34 (or homologs thereof). In some cases, a subject carbohydrate-utilization gene or gene set includes one or more nucleic acids encoding SEQ ID NOS.: 14-27 (or homologs thereof). In some cases, a subject carbohydrate-utilization gene or gene set includes one or more nucleic acids encoding SEQ ID NOS.: 18-34 (or homologs thereof). In some cases, a subject carbohydrate-utilization gene or gene set includes one or more nucleic acids encoding SEQ ID NOS.: 14-17 (or homologs thereof) as well as both porphyranases from within SEQ ID NOS.: 18-27 (or homologs thereof). In some cases, a subject carbohydrate-utilization gene or gene set includes one or more nucleic acids encoding SEQ ID NOS.: 28-34 (or homologs thereof) as well as both porphyranases from within SEQ ID NOS.: 18-27 (or homologs thereof). In some cases, a subject carbohydrate-utilization gene or gene set includes one or more nucleic acids encoding SEQ ID NOS.: 14-17 and SEQ ID NOS.: 28-34 (or homologs thereof) as well as both porphyranases from within SEQ ID NOS.: 18-27 (or homologs thereof).

As such, in some cases, a subject carbohydrate-utilization gene or gene set includes one or more nucleic acids encoding proteins that have 80% or more sequence identity (e.g., 85% or more, 90% or more, 95% or more, or 100% sequence identity) with SEQ ID NOS.: 14-34 (see, e.g., Table 6). In some cases, a subject carbohydrate-utilization gene or gene set includes one or more nucleic acids encoding proteins that have 80% or more sequence identity (e.g., 85% or more, 90% or more, 95% or more, or 100% sequence identity) with SEQ ID NOS.: 14-17. In some cases, a subject carbohydrate-utilization gene or gene set includes one or more nucleic acids encoding proteins that have 80% or more sequence identity (e.g., 85% or more, 90% or more, 95% or more, or 100% sequence identity) with SEQ ID NOS.: 28-34. In some cases, a subject carbohydrate-utilization gene or gene set includes one or more nucleic acids encoding proteins that have 80% or more sequence identity (e.g., 85% or more, 90% or more, 95% or more, or 100% sequence identity) with SEQ ID NOS.: 14-17 and SEQ ID NOS.: 28-34. In some cases, a subject carbohydrate-utilization gene or gene set includes one or more nucleic acids encoding proteins that have 80% or more sequence identity (e.g., 85% or more, 90% or more, 95% or more, or 100% sequence identity) with SEQ ID NOS.: 14-27. In some cases, a subject carbohydrate-utilization gene or gene set includes one or more nucleic acids encoding proteins that have 80% or more sequence identity (e.g., 85% or more, 90% or more, 95% or more, or 100% sequence identity) with SEQ ID NOS.: 18-34. In some cases, a subject carbohydrate-utilization gene or gene set includes one or more nucleic acids encoding proteins that have 80% or more sequence identity (e.g., 85% or more, 90% or more, 95% or more, or 100% sequence identity) with SEQ ID NOS.: 14-17 as well as both porphyranases set forth as SEQ ID NOs.: 19 and 21. In some cases, a subject carbohydrate-utilization gene or gene set includes one or more nucleic acids encoding proteins that have 80% or more sequence identity (e.g., 85% or more, 90% or more, 95% or more, or 100% sequence identity) with SEQ ID NOS.: 28-34 as well as both porphyranases set forth as SEQ ID NOs.: 19 and 21. In some cases, a subject carbohydrate-utilization gene or gene set includes one or more nucleic acids encoding proteins that have 80% or more sequence identity (e.g., 85% or more, 90% or more, 95% or more, or 100% sequence identity) with SEQ ID NOS.: 14-17 and SEQ ID NOS.: 28-34 as well as both porphyranases set forth as SEQ ID NOs.: 19 and 21.

In some cases, a subject carbohydrate-utilization gene or gene set includes one or more nucleic acids encoding (i) at least one of SEQ ID NOs.: 19, 21, and 22 (or a homolog(s) thereof); (ii) at least one of SEQ ID NOs.: 26 and 33 (or a homolog(s) thereof); and (iii) at least one of SEQ ID NOs.: 25 and 32 (or a homolog(s) thereof). In some cases, a subject carbohydrate-utilization gene or gene set encodes SEQ ID NOs.: 19, 21-22, 25, 26, and 32-33 (or a homologs thereof).

In some cases, a subject carbohydrate-utilization gene or gene set includes one or more nucleic acids encoding (i) at least one protein that has 80% or more sequence identity (e.g., 85% or more, 90% or more, 95% or more, or 100% sequence identity) with any one of SEQ ID NOs.: 19, 21, and 22; (ii) at least one protein that has 80% or more sequence identity (e.g., 85% or more, 90% or more, 95% or more, or 100% sequence identity) with any one of SEQ ID NOs.: 26 and 33; and (iii) at least one protein that has 80% or more sequence identity (e.g., 85% or more, 90% or more, 95% or more, or 100% sequence identity) with any one of SEQ ID NOs.: 25 and 32. In some cases, a subject carbohydrate-utilization gene or gene set includes one or more nucleic acids encoding proteins having 80% or more sequence identity (e.g., 85% or more, 90% or more, 95% or more, or 100% sequence identity) with SEQ ID NOs.: 19, 21-22, 25, 26, and 32-33.

In some embodiments, the carbohydrate-utilization gene set includes at least 3 genes (e.g., at least 4, at least 5, at least 6, at least 8 genes, at least 10 genes, at least 12 genes, at least 15 genes, or at least 20 genes). In some cases, the carbohydrate-utilization gene set includes from 3-30 genes (e.g., from 5-30, 3-25, 3-20, 3-15, 3-10, 3-8, 5-25, 5-20, 5-15, 5-10, 5-8, 8-30, 8-25, 8-20, 8-15, 10-30, 10-25, 10-20, 10-15, 12-30, 12-25, 12-20, 15-30, 15-25, 20-30, or 20-25 genes). In some cases, the carbohydrate-utilization gene set includes from 3-10 genes.

A nucleic acid that includes the carbohydrate-utilization gene or gene set (e.g., a heterologous carbohydrate-utilization gene or gene set) may or may not be integrated (covalently linked) into the genome of the cell. For example, in some cases, the nucleic acid that includes the carbohydrate-utilization gene or gene set is integrated into the genome of the cell (as a chromosomal integrant). In some cases, the nucleic acid that includes the carbohydrate-utilization gene or gene set is maintained on an episomal element (extra chromosomal element) such as a plasmid.

In some cases the expression of genes from the carbohydrate-utilization gene or gene set is controlled by a high expression promoter. In some cases the expression of genes from the carbohydrate-utilization gene or gene set is controlled by an inducible promoter, constitutive promoter, native promoter (e.g., native to the bacterial cell), heterologous promoter, or a promoter associated with the carbohydrate-utilization gene or gene set. Thus, for example, methods of the disclosure can be controlled by the type of promoter that is present. As an illustrative example, in some cases, entrenchment (e.g., of a subject genetically modified bacterial cell into an organ of an individual, e.g., into the individual's gut) is controlled by a high expression promoter. Likewise, in some cases entrenchment (e.g., of a subject genetically modified bacterial cell into an organ of an individual, e.g., into the individual's gut) is controlled by an inducible promoter, constitutive promoter, native promoter (e.g., native to the bacterial cell), heterologous promoter, or a promoter associated with the carbohydrate-utilization gene or gene set.

Therapy etc.

The strategy disclosed here for facilitating robust colonization can facilitate a range of therapeutic applications, e.g., where it can be important to establish a high and/or predictable number of natural or engineered therapeutic microbes. For example, it may be important to colonize an organ (e.g., gut) at a high enough level to ensure that therapeutic activities may overcome competing activities of other microbes. As an example, this may be important when attempting to, for instance, change the short chain fatty acid profile or reduce the accumulation of harmful chemicals that are produced in the gut. Achieving predictable colonization can also be important for therapeutics that must be carefully dosed, such as bacteria with pro- or anti-inflammatory activities which could be used as an adjuvant for cancer immunotherapy or in the treatment of Inflammatory Bowel Diseases. The methods of the disclosure could also be used to, for example, ensure robust colonization to displace a harmful species by establishing a non-harmful version that can effectively compete for limiting resources with the harmful strain. As such, and as noted elsewhere, in some cases a subject method can result in displacement of bacteria present in the gut of an individual.

A subject genetically modified bacterial cell can be introduced into a variety of individuals with a variety of ailments. Diseases that can be treated with a subject genetically modified bacterial cell include but are not limited to diseases that are impacted by the gut microbiota, which include obesity, diabetes, heart disease, central nervous system diseases, rheumatoid arthritis, metabolic disorders, and cancer. For example, in some cases, the individual has gut inflammation, and in some such cases the individual has an inflammatory disease (e.g., Crohn's disease, ulcerative colitis, and the like), and in some cases gut inflammation can indirectly impact the disease, such as colorectal cancer or obesity.

In some cases, a subject bacterial cell is a therapeutic cell (has a positive impact on a clinical parameter of the individual). A therapeutic cell is not necessarily a genetically modified cell. For example, a cell that has not been genetically modified may serve a therapeutic purpose to an individual. In some cases, a therapeutic cell is genetically modified. For example, in some cases a therapeutic cell includes a transgene that encodes a therapeutic peptide (e.g., a peptide that when expressed by—and in some cases secreted by—a cell can have a positive impact on the health of an individual). For example, a therapeutic cell and/or therapeutic peptide can have antimicrobial (antibiotic) activity (e.g., against one or more gut microbes), can function to change gut environmental parameters (e.g., pH control), can affect inflammation, can provide an enzymatic activity, and the like.

In some cases, a genetically modified bacterial cell includes a transgene that is an enzyme (e.g., a metabolic enzyme). For example, there are many small molecules produced in the gut (e.g., produced by microbes) that accumulate in the blood and cause or exacerbate diseases. Expressing an enzyme or a pathway (as a transgene) in a *Bacteroides* cell (or population of cells) to break down these products can be used in methods of treatment. For example, a *Bacteroides* cell expressing such a transgene can be introduced into the gut of an individual (e.g., in order to break down small molecules, which in some cases may be produced by microbes, to reduce or even eliminate the amount absorbed by the gut of the individual, reducing the accumulation of the molecules in the blood of the individual).

In some cases, a genetically modified bacterial cell is tagged (e.g., to aid in tracking). For example, in some cases, a genetically modified bacterial cell of the disclosure includes a detectable label (e.g., a nucleic acid that results in the presence of a detectable signal). As such, in some cases, a subject genetically modified cell (or population of cells) that is introduced into an individual (e.g., the gut), includes a transgene whose expression detectably labels the cell. The phrase "detectably label" as used herein refers to any expression product (RNA, protein) that is detectable. The expression product (the label) can itself be detectable (directly detectable label) (e.g., a fluorescent protein), or the label can be indirectly detectable, e.g., in the case of an enzymatic label, the enzyme (e.g., luciferase or recombinase) may catalyze a chemical alteration of a substrate compound, composition or nucleic acid sequence and the product of the reaction is detectable (e.g. by fluorescence, chemiluminescence, sequencing or presence and/or size of a PCR product). Thus in some cases, any of the methods of the disclosure can include a step of detecting (e.g., measuring) a detectable signal produced by a subject genetically modified bacterial cell. As an illustrative example, in some cases a genetically modified bacterial cell includes a transgene that encodes a fluorescent protein (e.g., green fluorescent protein (GFP) or any of a number of derivatives of GFP such as YFP, CFP, RFP, etc.) or an enzyme that produces a fluorescent signal (e.g., luciferase), and a subject method includes a step of measuring the signal to detect the presence of (e.g., measure the abundance of) the genetically modified bacterial cell after it has been introduced into an individual (e.g., 3 days, 4 days, 5 days, 6 days, and/or 7 days after introduction; and/or 3 days, 4 days, 5 days, 6 days, and/or 7 days after providing the carbohydrate of interest).

In some cases, a genetically modified bacterial cell includes a transgene that is a "marker" or "marker gene" or "marker protein." A marker is an expression product (e.g., mRNA, protein, non-coding RNA) that marks a host cell such that the host cell is detectable (e.g., detectably labeled). In some cases, the host cell is detectable by virtue of survival (e.g., the marker can be a "selectable marker"). In some cases, the host cell is detectable by observation (e.g., by direct visualization, by performing an assay, by performing a measurement step, and the like) and the marker can be referred to as a "reporter" or "reporter gene" or "reporter protein."

As noted above, some markers are "selectable markers." Selectable markers (a "selectable marker gene" can encode a "selectable marker protein") provide for selection, i.e., for selective retention of cells (e.g., prokaryotic cells) that comprise the selectable marker gene, during culturing and propagation of the cells. An example of a selectable marker is a transgene that encodes a drug selectable marker protein that provides drug resistance for prokaryotic cells (e.g., *Bacteroides* cells). Such a selectable marker encodes a drug selectable marker protein that provides resistance for prokaryotic cells to one or more drugs (e.g., kanamycin, neomycin, ampicillin, carbenicillin, chloramphenicol, gentamicin, tetracycline, rifampin, trimethoprim, hygromycin B, spectinomycin, and the like). In some cases, a subject genetically modified bacteria can include an erythromycin resistance cassette. Proteins that provide drug resistance to cells (e.g., prokaryotic cells) in which they are expressed are known in the art. For example, wild type genes/proteins are known that provide resistance (e.g., for prokaryotic cells) to the above drugs. For example, aminoglycoside 3'-phosphotransferase (APH), is a wild type protein that provides for resistance to the drugs Kanamycin, Neomycin and Geneticin (G418); while beta-lactamase is a wild type protein that provides for resistance to the drugs ampicillin and carbenecillin. Chloramphenicol acetyltransferase (cat) confers resistance to chloramphenicol. Genes conferring resistance to aminoglycosides include aac, aad, aph and strA/B. Genes conferring resistance to β-lactams include ampC, cmy, tem and vim. Genes conferring resistance to sulfonamides include sulI and sulII. Genes conferring resistance to tetracycline include tet(A), tet(B), tet(C), tet(D) and regulator, and tetR. Selectable markers can also be those useful in balanced lethal systems, e.g., in which an essential gene is maintained on a plasmid with a corresponding chromosomal deletion or suppressible mutation on the host cell genome, e.g. a tRNA selectable marker that suppresses a host chromosomal gene mutation; those useful in repressor titration systems, in which an operator sequences, e.g. the lac operator or tet operator, placed on a plasmid, derepresses a chromosomal gene; antidote/poison selection schemes, in which an antidote to a poison expressed from the host chromosome (e.g. the ccdB gene) is maintained on the plasmid; and those useful in RNA-based selection schemes, e.g. antisense regulators, or antisense regulators that inhibit the translation of a gene transcribed from the host chromosome that would otherwise promote cell death.

*Bacteroides* Cells

In any of the embodiments of the disclosure, the bacterial cell of interest (e.g., the genetically modified cell, the cell being modified or introduced, or whose growth is being modulated, as part of a subject composition or method) can be a *Bacteroides* cell. In some cases, the bacterial cell of interest is not a *Bacteroides* cell. For example, the bacterial cell of interest can be any desired species, e.g., when the target organ is a gut the bacterial cell can be any species that can colonize a gut. In some cases the bacterial cell of interest is a *Clostridium* species (i.e., is a cell of the genus *Clostridium*).

The term "*Bacteroides* cell" is used herein to refer to a cell of the genus *Bacteroides*. As such, in some cases, a subject cell is a *Bacteroides* cell. Examples of species within the genus *Bacteroides* include but are not limited to: *B. fragilis* (Bf), *B. distasonis* (Bd), *B. thetaiotaomicron* (Bt), *B. vulgatus* (By), *B. ovatus* (Bo), *B. eggerrthii* (Be), *B. merdae* (Bm), *B. stercoris* (Bs), *B. uniformis* (Bu), and *B. caccae* (Bc). In some cases, a *Bacteroides* cell is a species selected from: *B. acidifaciens, B. amylophilus, B. asaccharolyticus, B. bamesiae, B. bivius, B. buccae, B. buccalis, B. caccae, B. capillosus, B. capillus, B. cellulosilyticus, B. cellulosolvens, B. chinchilla, B. clarus, B. coagulans, B. coprocola, B. coprophilus, B. coprosuis, B. corporis, B. denticola, B. disiens, B. distasonis, B. dorei, B. eggerthii, B. endodontalis, B. faecichinchillae, B. faecis, B. finegoldii, B. fluxus, B. forsythus, B. fragilis, B. furcosus, B. galacturonicus, B. gallinarum, B. gingivalis, B. goldsteinii, B. gracilis, B. graminisolvens, B. helcogenes, B. heparinolyticus, B. hypermegas, B. intermedius, B. intestinalis, B. johnsonii, B. levvi, B. loescheii, B. macacae, B. massiliensis, B. melaninogenicus, B. merdae, B. microfusus, B. multiacidus, B. nodosus, B. nordii, B. ochraceus, B. oleiciplenus, B. oralis, B. oris, B. oulorum, B. ovatus, B. paurosaccharolyticus, B. pectinophilus, B. pentosaceus, B. plebeius, B. pneumosintes, B. polypragmatus, B. praeacutus, B. propionicifaciens, B. putredinis, B. pyogenes, B. reticulotermitis, B. rodentium, B. ruminicola, B. salanitronis, B. salivosus, B. salyersiae, B.*

*sartorii*, *B. splanchnicus*, *B. stercorirosoris*, *B. stercoris*, *B. succinogenes*, *B. suis*, *B. tectus*, *B. termitidis*, *B. thetaiotaomicron*, *B. uniformis*, *B. ureolyticus*, *B. veroralis*, *B. vulgatus*, *B. xylanisolvens*, *B. xylanolyticus*, and *B. zoogleoformans*. In some cases, a subject *Bacteroides* cell is a species selected from: *B. fragilis* (Bf), *B. thetaiotaomicron* (Bt), *B. vulgatus* (By), *B. ovatus* (Bo), and *B. uniformis* (Bu).

In some cases, the *Bacteroides* cell is a species selected from: *B. fragilis* (Bf), *B. distasonis* (Bd), *B. thetaiotaomicron* (Bt), *B. vulgatus* (By), *B. ovatus* (Bo), *B. eggerrthii* (Be), *B. merdae* (Bm), *B. stercoris* (Bs), *B. uniformis* (Bu), and *B. caccae* (Bc). In some cases, the *Bacteroides* cell is a species selected from: *B. fragilis* (Bf), *B. thetaiotaomicron* (Bt), *B. vulgatus* (By), *B. ovatus* (Bo), and *B. uniformis* (Bu). In some cases, the *Bacteroides* cell is a species selected from: *B. thetaiotaomicron* (Bt), *B. vulgatus* (By), *B. ovatus* (Bo), and *B. uniformis* (Bu). In some cases, the *Bacteroides* cell is *B. thetaiotaomicron* (Bt).

Kits

Also provided are kits, e.g., for practicing any of the above methods. The contents of the subject kits may vary greatly. A kit can include, for example: (i) a subject genetically modified bacterial cell, and (ii) a rare carbohydrate of interest that can be utilized by the genetically modified bacterial cell. In some case, the genetically modified bacterial cell is a therapeutic cell.

In addition to the above components, the subject kits can further include instructions for practicing the subject methods. These instructions may be present in the subject kits in a variety of forms, one or more of which may be present in the kit. One form in which these instructions may be present is as printed information on a suitable medium or substrate, e.g., a piece or pieces of paper on which the information is printed, in the packaging of the kit, in a package insert, etc. Yet another means would be a computer readable medium, e.g., diskette, CD, flash drive, etc., on which the information has been recorded. Yet another means that may be present is a website address which may be used via the internet to access the information at a removed site. Any convenient means may be present in the kits.

Examples of Non-Limiting Aspects of the Disclosure

Aspects, including embodiments, of the present subject matter described above may be beneficial alone or in combination, with one or more other aspects or embodiments. Without limiting the foregoing description, certain non-limiting aspects of the disclosure numbered 1-98 are provided below. As will be apparent to those of skill in the art upon reading this disclosure, each of the individually numbered aspects may be used or combined with any of the preceding or following individually numbered aspects. This is intended to provide support for all such combinations of aspects and is not limited to combinations of aspects explicitly provided below:

1. A method, comprising: introducing to a human organ a genetically modified bacterial cell capable of controlled entrenchment and/or controlled colonization.
2. A method for modulating growth of a genetically modified bacterial cell present in a human organ, comprising: administering to a human a rare carbohydrate of interest that is utilized as a carbon source by the genetically modified bacterial cell, wherein less than 50% (e.g., less than 30%, less than 10%, less than 3%, less than 1%, less than 0.3%, less than 0.1%, less than 0.03%, less than 0.01%, less than 0.003%, less than 0.001%, less than 0.0001%, or none) of other bacterial cells present in the human organ utilize the rare carbohydrate of interest as a carbon source.
3. A method for modulating growth of a genetically modified bacterial cell in an organ, comprising: introducing the genetically modified bacterial cell to the organ in vivo, wherein the genetically modified bacterial cell utilizes as a carbon source a rare carbohydrate of interest, wherein less than 50% (e.g., less than 30%, less than 10%, less than 3%, less than 1%, less than 0.3%, less than 0.1%, less than 0.03%, less than 0.01%, less than 0.003%, less than 0.001%, less than 0.0001%, or none) of other bacterial cells present in the organ utilize the rare carbohydrate of interest as a carbon source.
4. A method for displacing at least a portion of a population of bacterial cells in an organ, comprising: introducing to the organ a genetically modified bacterial cell capable of controlled entrenchment and/or controlled colonization, and displacing at least a portion of the population of bacterial cells with the genetically modified bacterial cell.
5. The method of 4, wherein the genetically modified bacterial cell and the bacterial cells in the population of bacterial cells are the same species.
6. The method of 4 or 5, further comprising providing a bacterial cell from the population of bacterial cells and removing or inactivating one or more genes in the bacterial cell, thereby generating the genetically modified bacterial cell.
7. The method of 3 or 4, wherein the organ is a human organ.
8. The method of any one of the preceding, wherein the organ is a gut.
9. The method of 1 or 4, wherein the controlled entrenchment and/or controlled colonization is controlled by a high expression promoter.
10. The method of 1 or 4, wherein the controlled entrenchment and/or controlled colonization is controlled by an inducible promoter.
11. The method of 1 or 4, wherein the controlled entrenchment and/or controlled colonization is controlled by delivering a rare carbohydrate of interest to the organ.
12. The method of 11, wherein the rare carbohydrate of interest is a carbohydrate that can be utilized as a carbon source by less than 50% (e.g., less than 30%, less than 10%, less than 3%, less than 1%, less than 0.3%, less than 0.1%, less than 0.03%, less than 0.01%, less than 0.003%, less than 0.001%, less than 0.0001%, or none) of other bacterial cells present in the organ, thereby generating a privileged niche.
13. The method of any one of 2-3 and 11-12, wherein the rare carbohydrate of interest is an isolated carbohydrate.
14. The method of any one of 2-3 and 11-13, wherein the rare carbohydrate of interest is a polysaccharide.
15. The method of any one of 2-3 and 11-14, wherein the rare carbohydrate of interest is a sulfated carbohydrate.
16. The method of any one of 2-3 and 11-14, wherein the rare carbohydrate of interest is selected from the group consisting of porphyran, agarose, carrageenan, and any combination thereof.
17. The method of any one of 2-3 and 11-16, wherein the rare carbohydrate of interest is a carbohydrate cleaved by a glycoside hydrolase belonging to glycoside hydrolase family GH86.
18. The method of any one of 2-3 and 11-17, wherein the rare carbohydrate of interest is a sulfated polygalactan.
19. The method of any one of the preceding, wherein the genetically modified bacterial cell is a genetically modified gut resident bacterial cell.

20. The method of any one of the preceding, wherein the genetically modified bacterial cell is in the genus *Bacteroides*.

21. The method of any one of the preceding, wherein the genetically modified bacterial cell is selected from *B. acidifaciens, B. amylophilus, B. asaccharolyticus, B. barnesiae, B. bivius, B. buccae, B. buccalis, B. caccae, B. capillosus, B. capillus, B. cellulosilyticus, B. cellulosolvens, B. chinchilla, B. clarus, B. coagulans, B. coprocola, B. coprophilus, B. coprosuis, B. corporis, B. denticola, B. disiens, B. distasonis, B. dorei, B. eggerthii, B. endodontalis, B. faecichinchillae, B. faecis, B. finegoldii, B. fluxus, B. forsythus, B. fragilis, B. furcosus, B. galacturonicus, B. gallinarum, B. gingivalis, B. goldsteinii, B. gracilis, B. graminisolvens, B. helcogenes, B. heparinolyticus, B. hypermegas, B. intermedius, B. intestinalis, B. johnsonii, B. levii, B. loescheii, B. macacae, B. massiliensis, B. melaninogenicus, B. merdae, B. microfusus, B. multiacidus, B. nodosus, B. nordii, B. ochraceus, B. oleiciplenus, B. oralis, B. oris, B. oulorum, B. ovatus, B. paurosaccharolyticus, B. pectinophilus, B. pentosaceus, B. plebeius, B. pneumosintes, B. polypragmatus, B. praeacutus, B. propionicifaciens, B. putredinis, B. pyogenes, B. reticulotermitis, B. rodentium, B. ruminicola, B. salanitronis, B. salivosus, B. salyersiae, B. sartorii, B. splanchnicus, B. stercorirosoris, B. stercoris, B. succinogenes, B. suis, B. tectus, B. termitidis, B. thetaiotaomicron, B. uniformis, B. ureolyticus, B. veroralis, B. vulgatus, B. xylanisolvens, B. xylanolyticus, B. zoogleoformans*, and any combination thereof.

22. The method of any one of the preceding, wherein the genetically modified bacterial cell comprises a carbohydrate-utilization gene or gene set.

23. The method of 22, wherein the carbohydrate-utilization gene or gene set comprises one or more genes selected from the group consisting of porphyranase, glycoside hydrolase, sulfatase, galactosidase, and any combination thereof.

24. The method of 22, wherein the carbohydrate-utilization gene or gene set comprises one or more nucleic acids encoding proteins that have 80% or more sequence identity with BACPLE_1683-1706 from the *B. plebeius* genome.

25. The method of any one of 22-24, wherein the carbohydrate-utilization gene set comprises at least six genes.

26. The method of any one of 22-25, wherein the carbohydrate of interest cannot be utilized as a carbon source by the genetically modified bacterial cell in the absence of the carbohydrate-utilization gene or gene set.

27. The method of any one of 22-26, wherein the carbohydrate-utilization gene or gene set is heterologous.

28. The method of 27, wherein the carbohydrate-utilization gene or gene set is encoded on a plasmid, encoded on a bacterial artificial chromosome, or genomically integrated.

29. The method of any one of the preceding, wherein the genetically modified bacterial cell is capable of treating a metabolic disease or disorder.

30. The method of any one of the preceding, wherein the genetically modified bacterial cell comprises one or more therapeutic transgenes.

31. The method of 30, wherein the one or more therapeutic transgenes comprise one or more enzymes.

32. The method of any one of 2-3 and 11-18, further comprising administering the rare carbohydrate of interest for a sufficient amount of time and at a sufficient frequency to establish a population of the genetically modified bacterial cell.

33. The method of 32, further comprising maintaining the population of the genetically modified bacterial cell in the organ for at least 5 days.

34. The method of any one of 2-3 and 11-18, further comprising administering the rare carbohydrate of interest for at least 3 days.

35. The method of any one of the preceding, wherein the genetically modified bacterial cell is introduced orally.

36. The method of any one of the preceding, wherein the organ comprises at least 5 other bacterial species.

37. The method of any one of the preceding, further comprising colonizing the organ with the genetically modified bacterial cell at a level of at least 1% of total bacterial cells in the organ.

38. A genetically modified bacterial cell that utilizes as a carbon source a rare carbohydrate of interest that is utilized as a carbon source by less than 50% (e.g., less than 30%, less than 10%, less than 3%, less than 1%, less than 0.3%, less than 0.1%, less than 0.03%, less than 0.01%, less than 0.003%, less than 0.001%, less than 0.0001%, or none) of bacterial cells present in a human microbiota.

39. A genetically modified bacterial cell, comprising:
a heterologous carbohydrate-utilization gene or gene set that provides the genetically modified bacterial cell with an ability to utilize as a carbon source a rare carbohydrate of interest that is utilized as a carbon source by less than 50% (e.g., less than 30%, less than 10%, less than 3%, less than 1%, less than 0.3%, less than 0.1%, less than 0.03%, less than 0.01%, less than 0.003%, less than 0.001%, less than 0.0001%, or none) of bacterial cells present in a human microbiota.

40. A genetically modified bacterial cell, comprising:
(i) a heterologous therapeutic transgene; and
(ii) a carbohydrate-utilization gene or gene set that provides the genetically modified bacterial cell with an ability to utilize as a carbon source a rare carbohydrate of interest that is utilized as a carbon source by less than 50% (e.g., less than 30%, less than 10%, less than 3%, less than 1%, less than 0.3%, less than 0.1%, less than 0.03%, less than 0.01%, less than 0.003%, less than 0.001%, less than 0.0001%, or none) of bacterial cells present in a human microbiota.

41. The genetically modified bacterial cell of any one of 38-40, wherein the rare carbohydrate of interest is an isolated carbohydrate.

42. The genetically modified bacterial cell of any one of 38-41, wherein the rare carbohydrate of interest is a polysaccharide.

43. The genetically modified bacterial cell of any one of 38-42, wherein the rare carbohydrate of interest is a sulfated carbohydrate.

44. The genetically modified bacterial cell of any one of 38-42, wherein the rare carbohydrate of interest is selected from the group consisting of porphyran, agarose, carrageenan, and any combination thereof.

45. The genetically modified bacterial cell of any one of 38-44, wherein the rare carbohydrate of interest is a carbohydrate cleaved by a glycoside hydrolase belonging to glycoside hydrolase family GH86.

46. The genetically modified bacterial cell of any one of 38-45, wherein the rare carbohydrate of interest is a sulfated polygalactan.

47. The genetically modified bacterial cell of any one of 38-46, wherein the genetically modified bacterial cell is a genetically modified gut resident bacterial cell.

48. The genetically modified bacterial cell of any one of 38-47, wherein the genetically modified bacterial cell is in the genus *Bacteroides*.

49. The genetically modified bacterial cell of any one of 38-48, wherein the genetically modified bacterial cell is selected from *B. acidifaciens, B. amylophilus, B. asaccha-* rolyticus, B. barnesiae, B. bivius, B. buccae, B. buccalis, B. caccae, B. capillosus, B. capillus, B. cellulosilyticus, B. cellulosolvens, B. chinchilla, B. clarus, B. coagulans, B. coprocola, B. coprophilus, B. coprosuis, B. corporis, B. denticola, B. disiens, B. distasonis, B. dorei, B. eggerthii, B. endodontalis, B. faecichinchillae, B. faecis, B. finegoldii, B. fluxus, B. forsythus, B. fragilis, B. furcosus, B. galacturonicus, B. gallinarum, B. gingivalis, B. goldsteinii, B. gracilis, B. graminisolvens, B. helcogenes, B. heparinolyticus, B. hypermegas, B. intermedius, B. intestinalis, B. johnsonii, B. lewi, B. loescheii, B. macacae, B. massiliensis, B. melaninogenicus, B. merdae, B. microfusus, B. multiacidus, B. nodosus, B. nordii, B. ochraceus, B. oleiciplenus, B. oralis, B. oris, B. oulorum, B. ovatus, B. paurosaccharolyticus, B. pectinophilus, B. pentosaceus, B. plebeius, B. pneumosintes, B. polypragmatus, B. praeacutus, B. propionicifaciens, B. putredinis, B. pyogenes, B. reticulotermitis, B. rodentium, B. ruminicola, B. salanitronis, B. salivosus, B. salyersiae, B. sartorii, B. splanchnicus, B. stercorirosoris, B. stercoris, B. succinogenes, B. suis, B. tectus, B. termitidis, B. thetaiotaomicron, B. uniformis, B. ureolyticus, B. veroralis, B. vulgatus, B. xylanisolvens, B. xylanolyticus, B. zoogleoformans, and any combination thereof.

50. The genetically modified bacterial cell of 38, wherein the genetically modified bacterial cell comprises a carbohydrate-utilization gene or gene set.

51. The genetically modified bacterial cell of 39, 40, or 50, wherein the carbohydrate-utilization gene or gene set comprises one or more genes selected from the group consisting of porphyranase, glycoside hydrolase, sulfatase, galactosidase, and any combination thereof.

52. The genetically modified bacterial cell of any one of 39-40 and 50-51, wherein the carbohydrate-utilization gene or gene set comprises one or more nucleic acids encoding proteins that have 80% or more sequence identity with BACPLE_1683-1706 from the B. plebeius genome.

53. The genetically modified bacterial cell of any one of 39-40 and 50-52, wherein the carbohydrate-utilization gene set comprises at least six genes.

54. The genetically modified bacterial cell of any one of 39-40 and 50-53, wherein the carbohydrate of interest cannot be utilized as a carbon source by the genetically modified bacterial cell in the absence of the carbohydrate-utilization gene or gene set.

55. The genetically modified bacterial cell of 40 or 50, wherein the carbohydrate-utilization gene or gene set is heterologous.

56. The genetically modified bacterial cell of 39 or 55, wherein the carbohydrate-utilization gene or gene set is encoded on a plasmid, encoded on a bacterial artificial chromosome, or genomically integrated.

57. The genetically modified bacterial cell of any one of 38-56, wherein the genetically modified bacterial cell is capable of treating a metabolic disease or disorder.

58. The genetically modified bacterial cell of any one of 38-57, wherein the genetically modified bacterial cell comprises one or more therapeutic transgenes.

59. The genetically modified bacterial cell of 58, wherein the one or more therapeutic transgenes comprise one or more enzymes.

60. A method comprising:
providing a bacterial cell; and
genetically modifying the bacterial cell to utilize as a carbon source a rare carbohydrate of interest that is utilized as a carbon source by less than 50% (e.g., less than 30%, less than 10%, less than 3%, less than 1%, less than 0.3%, less than 0.1%, less than 0.03%, less than 0.01%, less than 0.003%, less than 0.001%, less than 0.0001%, or none) of bacterial cells present in a human microbiome.

61. A method comprising:
providing a bacterial cell that utilizes as a carbon source a rare carbohydrate of interest that is utilized as a carbon source by less than 50% (e.g., less than 30%, less than 10%, less than 3%, less than 1%, less than 0.3%, less than 0.1%, less than 0.03%, less than 0.01%, less than 0.003%, less than 0.001%, less than 0.0001%, or none) of bacterial cells present in a human microbiome; and
genetically modifying the bacterial cell to express one or more therapeutic transgenes.

62. The method of 60 or 61, wherein the rare carbohydrate of interest is an isolated carbohydrate.

63. The method of any one of 60-62, wherein the rare carbohydrate of interest is a polysaccharide.

64. The method of any one of 60-63, wherein the rare carbohydrate of interest is a sulfated carbohydrate.

65. The method of any one of 60-63, wherein the rare carbohydrate of interest is selected from the group consisting of porphyran, agarose, carrageenan, and any combination thereof.

66. The method of any one of 60-65, wherein the rare carbohydrate of interest is a carbohydrate cleaved by a glycoside hydrolase belonging to glycoside hydrolase family GH86.

67. The method of any one of 60-66, wherein the rare carbohydrate of interest is a sulfated polygalactan.

68. The method of any one of 60-67, wherein the genetically modified bacterial cell is a genetically modified gut resident bacterial cell.

69. The method of any one of 60-68, wherein the genetically modified bacterial cell is in the genus Bacteroides.

70. The method of any one of 60-69, wherein the genetically modified bacterial cell is selected from B. acidifaciens, B. amylophilus, B. asaccharolyticus, B. barnesiae, B. bivius, B. buccae, B. buccalis, B. caccae, B. capillosus, B. capillus, B. cellulosilyticus, B. cellulosolvens, B. chinchilla, B. clarus, B. coagulans, B. coprocola, B. coprophilus, B. coprosuis, B. corporis, B. denticola, B. disiens, B. distasonis, B. dorei, B. eggerthii, B. endodontalis, B. faecichinchillae, B. faecis, B. finegoldii, B. fluxus, B. forsythus, B. fragilis, B. furcosus, B. galacturonicus, B. gallinarum, B. gingivalis, B. goldsteinii, B. gracilis, B. graminisolvens, B. helcogenes, B. heparinolyticus, B. hypermegas, B. intermedius, B. intestinalis, B. johnsonii, B. levvi, B. loescheii, B. macacae, B. massiliensis, B. melaninogenicus, B. merdae, B. microfusus, B. multiacidus, B. nodosus, B. nordii, B. ochraceus, B. oleiciplenus, B. oralis, B. oris, B. oulorum, B. ovatus, B. paurosaccharolyticus, B. pectinophilus, B. pentosaceus, B. plebeius, B. pneumosintes, B. polypragmatus, B. praeacutus, B. propionicifaciens, B. putredinis, B. pyogenes, B. reticulotermitis, B. rodentium, B. ruminicola, B. salanitronis, B. salivosus, B. salyersiae, B. sartorii, B. splanchnicus, B. stercorirosoris, B. stercoris, B. succinogenes, B. suis, B. tectus, B. termitidis, B. thetaiotaomicron, B. uniformis, B. ureolyticus, B. veroralis, B. vulgatus, B. xylanisolvens, B. xylanolyticus, B. zoogleoformans, and any combination thereof.

71. The method of any one of 60-70, wherein the genetically modified bacterial cell comprises a carbohydrate-utilization gene or gene set.

72. The method of 71, wherein the carbohydrate-utilization gene or gene set comprises one or more genes selected from the group consisting of porphyranase, glycoside hydrolase, sulfatase, galactosidase, and any combination thereof.

73. The method of 71 or 72, wherein the carbohydrate-utilization gene or gene set comprises one or more nucleic acids encoding proteins that have 80% or more sequence identity with BACPLE_1683-1706 from the *B. plebeius* genome.

74. The method of any one of 71-73, wherein the carbohydrate-utilization gene set comprises at least six genes.

75. The method of any one of 71-74, wherein the carbohydrate of interest cannot be utilized as a carbon source by the genetically modified bacterial cell in the absence of the carbohydrate-utilization gene or gene set.

76. The method of any one of 71-75, wherein the carbohydrate-utilization gene or gene set is heterologous.

77. The method of any one of 71-76, wherein the carbohydrate-utilization gene or gene set is encoded on a plasmid, encoded on a bacterial artificial chromosome, or genomically integrated.

78. The method of any one of 60-77, wherein the genetically modified bacterial cell is capable of treating a metabolic disease or disorder.

79. The method of 61, wherein the one or more therapeutic transgenes comprise one or more enzymes.

80. A method of facilitating colonization by a genetically modified bacterial cell, the method comprising:
    (a) introducing a genetically modified bacterial cell into a gut of an individual, wherein the genetically modified bacterial cell comprises a heterologous carbohydrate-utilization gene or gene set that provides the genetically modified bacterial cell with the ability to use a carbohydrate of interest as a carbon source; and
    (b) administering the carbohydrate of interest to the individual, thereby providing the genetically modified bacterial cell with the carbon source.

81. The method of 80, wherein the genetically modified bacterial cell is a genetically modified gut resident bacterial cell.

82. The method of 80 or 81, wherein the genetically modified bacterial cell is a *Bacteroides* cell.

83. The method of 82, wherein the *Bacteroides* cell is a *B. fragilis* (Bf), *B. distasonis* (Bd), *B. thetaiotaomicron* (Bt), *B. vulgatus* (By), *B. ovatus* (Bo), *B. eggerrthii* (Be), *B. merdae* (Bm), *B. stercoris* (Bs), *B. uniformis* (Bu), or *B. caccae* (Bc) cell.

84. The method of any one of 80-83, wherein the carbohydrate of interest cannot be utilized as a carbon source by the genetically modified bacterial cell in the absence of the heterologous carbohydrate-utilization gene or gene set.

85. The method of any one of 80-84, wherein the carbohydrate of interest is utilized as a carbon source by less than 50% (e.g., less than 30%, less than 10%, less than 3%, less than 1%, less than 0.3%, less than 0.1%, less than 0.03%, less than 0.01%, less than 0.003%, less than 0.001%, less than 0.0001%, or none) of other gut bacterial cells present in the gut of the individual.

86. The method of any one of 80-85, wherein the carbohydrate of interest is porphyran.

87. The method of 86, wherein the heterologous carbohydrate-utilization gene or gene set comprises one or more nucleic acids encoding the proteins that have 80% or more sequence identity with BACPLE_1683-1706 from the *B. plebeius* genome.

88. The method of any one of 80-87, wherein the genetically modified bacterial cell is a therapeutic bacterial cell.

89. The method of any one of 80-88, wherein the genetically modified bacterial cell comprises a nucleic acid molecule comprising a heterologous nucleic acid sequence that encodes a therapeutic polypeptide.

90. A genetically modified bacterial cell, comprising:
    a heterologous carbohydrate-utilization gene or gene set that provides the genetically modified bacterial cell with the ability to use a rare carbohydrate of interest as a carbon source.

91. The genetically modified bacterial cell of 90, wherein the genetically modified bacterial cell is a genetically modified gut resident bacterial cell.

92. The genetically modified bacterial cell of 90 or 91, wherein the genetically modified bacterial cell is a *Bacteroides* cell.

93. The genetically modified bacterial cell of 92, wherein the *Bacteroides* cell is a *B. fragilis* (Bf), *B. distasonis* (Bd), *B. thetaiotaomicron* (Bt), *B. vulgatus* (By), *B. ovatus* (Bo), *B. eggerrthii* (Be), *B. merdae* (Bm), *B. stercoris* (Bs), *B. uniformis* (Bu), or *B. caccae* (Bc) cell.

94. The genetically modified bacterial cell of any one of 90-93, wherein the carbohydrate of interest cannot be utilized as a carbon source by the genetically modified bacterial cell in the absence of the heterologous carbohydrate-utilization gene or gene set.

95. The genetically modified bacterial cell of any one of 90-94, wherein the carbohydrate of interest is porphyran.

96. The genetically modified bacterial cell of 95, wherein the heterologous carbohydrate-utilization gene or gene set comprises one or more nucleic acids encoding the proteins that have 80% or more sequence identity with BACPLE_1683-1706 from the *B. plebeius* genome.

97. The genetically modified bacterial cell of any of 90-96, wherein the genetically modified bacterial cell is a therapeutic bacterial cell.

98. The genetically modified bacterial cell of any of 90-97, wherein the genetically modified bacterial cell comprises a nucleic acid molecule comprising a heterologous nucleic acid sequence that encodes a therapeutic polypeptide.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Centigrade, and pressure is at or near atmospheric.

Example 1

To facilitate robust colonization, a privileged niche was created by introducing a carbohydrate into the diet that can only be utilized by the target bacteria. Remarkably, a single substrate was sufficient for boosting the colonization level of an introduced strain to more than half of the total microbes in the gut of conventional mice, which are expected to harbor hundreds of distinct bacterial strains. In addition to boosting total colonization levels, the data presented herein show that this privileged niche results in more predictable levels of target bacteria in different microbial communities. Finally, the data presented herein demonstrate that the ability to utilize the carbohydrate can be transferred to a naïve species.

Results
Selection of Polysaccharides Suitable for Establishing a Privileged Niche It was hypothesized that establishing a privileged niche that is inaccessible to other gut microbes would enable a predictably high level of colonization in the gut by an introduced bacteria capable of occupying the privileged niche. Most substrates that are known to be safely consumable by humans and to be capable of supporting growth of bacteria are readily consumed by the host or native bacterial species in the gut and thus do not produce a privileged niche. Due to the wide diversity in carbohydrate utilization capabilities amongst gut bacteria, carbohydrates were chosen as the substrate for creating a privileged niche. It was reasoned that carbohydrates that are uncommon in the diet and are either rarely or not consumed by the gut bacteria in the human population of interest would be suitable substrates for creating a privileged niche. The marine carbohydrates porphyran and agarose are both known to be safe to consume yet are rare in Western diets. The glycoside hydrolase family containing agarases and porphyranases, GH86, was found to be underrepresented in deeply-sequenced metagenomic stool samples from healthy adult Americans in the Human Microbiome Project (FIG. 1). Thus, these carbohydrates are likely to not be consumed by common American gut bacteria. In contrast to GH86, which was completely absent in 44% of samples and has a mean abundance of 0.00015, GH32, which hydrolyzes commonly consumed substrates such as the fructan polysaccharide inulin, was present in all samples and had a mean abundance of 0.0049.

Isolation of Strains Capable of Consuming Privileged Substrates

To isolate a strain of gut bacteria from the environment that was capable of growing on a carbohydrate of interest, a minimal media (see Salyers et al., Appl. Environ. Microbiol. 33, 319-322 (1977)) was designed for *Bacteroides*, the most abundant bacterial genus present in the Western gut, in which the carbohydrate of interest was the sole carbon source. Strains capable of utilizing porphyran, NB001, (FIG. 2, panel A) or agarose, NB002 and NB003, were isolated from the environment and the genomes of these strains were sequenced (Table 1). The porphyran utilizing strain NB001 contained a putative polysaccharide utilization locus (PUL) (SEQ ID NO: 67) on a mobile element that shares 71% identity with a previously identified porphyran-utilizing strain (Hehemann et al., Nature 464, 908-912 (2010); Hehemann et al., Proc. Natl. Acad. Sci. U.S.A 109, 19786-19791 (2012)). The two agarose utilizers were found to have a putative PUL (SEQ ID NO: 68 and 69) sharing over 99% identity between the two strains and include genes with high homology to agarases of marine bacteria.

TABLE 1

Description of bacterial strains.

| Name | Description | Species | Source |
| --- | --- | --- | --- |
| NB001 | Porphyran consuming *Bacteroides* | *Bacteroides ovatus* | environmental isolate |
| NB002 | Agarose consuming *Bacteroides* | *Bacteroides dorei* | environmental isolate |
| NB003 | Agarose consuming *Bacteroides* | *Bacteroides uniformis* | environmental isolate |
| NB004 | Porphyran naïve *Bacteroides* | *Bacteroides vulgatus* | environmental isolate |
| NB006 | NB001 with GFP/Erm marker | *Bacteroides ovatus* | NB001 + pWW124 (SEQ ID NO: 60) |

TABLE 1-continued

Description of bacterial strains.

| Name | Description | Species | Source |
| --- | --- | --- | --- |
| NB007 | Porphyran strain with tdk deletion | *Bacteroides ovatus* | NB001 + UV mut. |
| NB008 | Knockout of porphyran utilization | *Bacteroides ovatus* | NB001 +/− pWD034 (SEQ ID NO: 61) |
| NB009 | NB004 + Short Porphyran PUL | *Bacteroides vulgatus* | NB004 + pWD037 (SEQ ID NO: 62) |
| NB010 | NB004 + Medium Porphyran PUL | *Bacteroides vulgatus* | NB004 + pWD036 (SEQ ID NO: 63) |

Porphyran Establishes a Privileged Niche Resulting in Robust Colonization

An in vitro experiment was performed to test the hypothesis that addition of porphyran can increase the ability of an introduced porphyran utilizing bacteria to colonize a complex community at a high (and predictable) level. The strain NB006 was created by modifying NB001 to contain an erythromycin resistance cassette expressing GFP to facilitate monitoring abundance via plating. NB006 was added to the complex communities, which were then grown and serially passaged in rich media either in the presence or absence of porphyran (FIG. 2, panel B). In the absence of porphyran, NB006 colonization levels reached widely variable abundances across the 8 complex communities, spanning a 760-fold range by the seventh day. In the presence of porphyran, not only did the abundance of NB006 increase for all eight communities, but the deviation in abundance between the different communities also decreased considerably, spanning only a 3-fold range by the seventh day.

Next tested was the ability of porphyran to increase the abundance of NB006 in mice harboring a conventional complex microbiota (FIG. 2). One group of mice was given the standard (STD) rodent diet, while a second group was fed a polysaccharide deficient (PD) diet. After three days on each diet, both groups of mice received NB006. When both groups received 1% porphyran in the drinking water, abundance of NB006 increased by almost 3 logs in mice on the STD diet, and almost 4 logs in mice on the PD diet. Based on monitoring total anaerobic colony forming units, this represents an increase in NB006 from roughly 0.1% of total anaerobic CFU in both groups, to approximately 25% of total in mice fed the STD diet and 48% in mice fed the PD diet.

Additionally tested was the ability of porphyran to allow NB006 to stably colonize a microbiota that resists colonization. Mice were administered NB008, an isogenic strain to NB006 that cannot utilize porphyran, and this rendered them resistant to colonization by NB006 as this strain was cleared from the mice within five days after introduction (FIG. 2, panel D). When mice were administered porphyran for three days simultaneous to introduction of NB006, NB008 decreased in abundance by three logs while NB006 remained constant and highly abundant (roughly 67% of total anaerobic CFU). After removal of porphyran, NB008 increased back to pre-challenge levels while NB006 decreased to one log lower abundance than NB008. After re-introduction of porphyran for seven days, NB006 displaced NB008 in a stable fashion, maintaining colonization of the mice in the absence of porphyran for thirty days. Additionally, NB008 was now excluded from the mice when re-introduced (FIG. 2, panel E).

Figure 3:
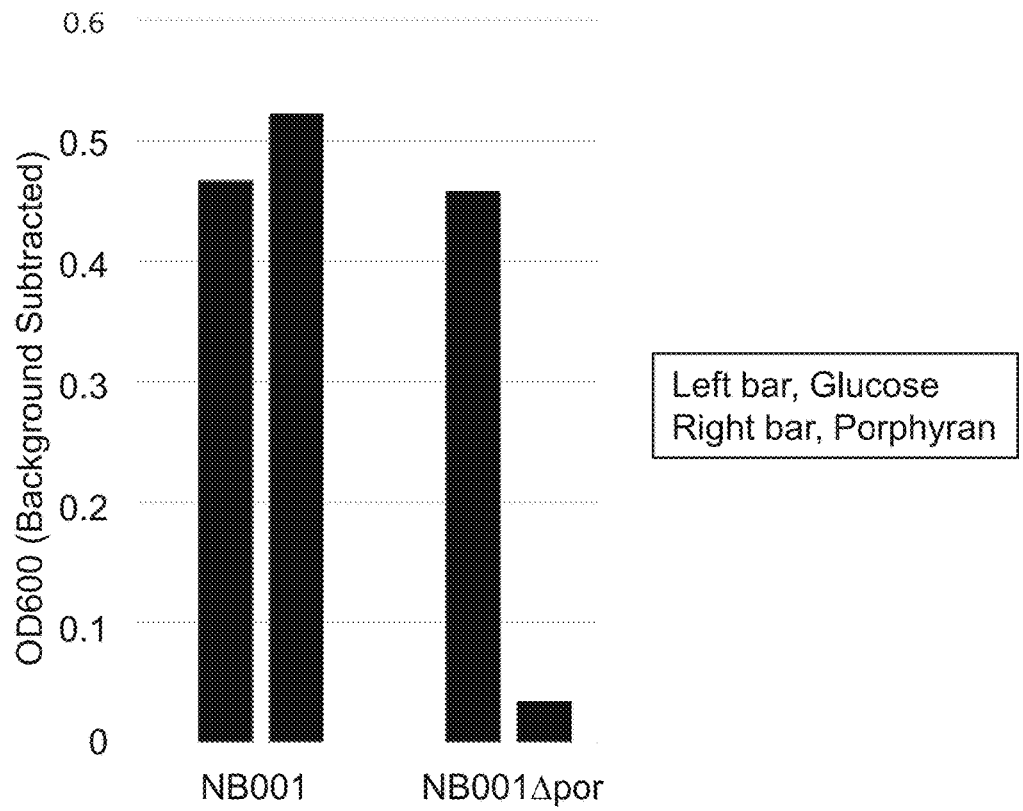
FIG. 3. Knockout of an eight-gene operon in the putative NB001 porphyran PUL prevents growth on porphyran. Genes corresponding to homologs of BACPLE_1692-1699 from *B. plebeius* were deleted from NB001. End-point cell density measurements were taken after growth in minimal media supplemented with either 0.2% glucose (blue) or 0.8% nori extract (orange).

Transferring the Key Porphyran Utilization Genes is Sufficient for Conferring Porphyran Utilization to a Naïve Species To confirm that the mobile element of interest in NB001 (see SEQ ID NO: 67) was necessary for the ability to grow on porphyran as a sole carbon source, an 8-gene operon was deleted that contained key glycoside hydrolases predicted to act on porphyran and constituted 16% of the mobile element. This deletion was sufficient to eliminate the ability to grow on porphyran (FIG. 3).

Figure 4:
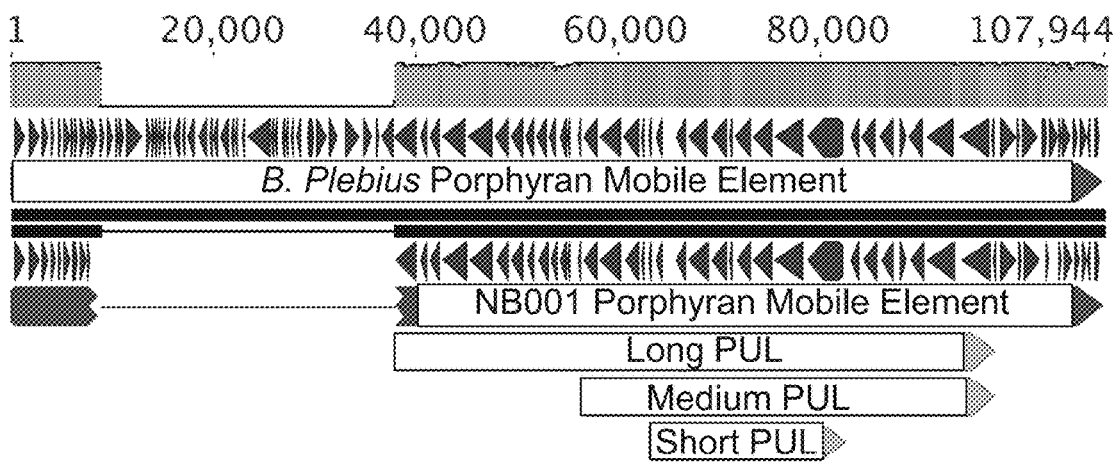
FIG. 4. Nucleotide alignment between the porphyran mobile elements in *B. plebeius* (Hehemann et al., Nature 464, 908-912 (2010); Hehemann et al., Proc. Natl. Acad. Sci. U.S.A 109, 19786-19791 (2012)) and NB001. Three truncations of the putative porphyran polysaccharide utilization locus (PUL), shown in green, were cloned into a conjugation vector and transferred to a naive strain to assay growth on porphyran.
Figure 5:
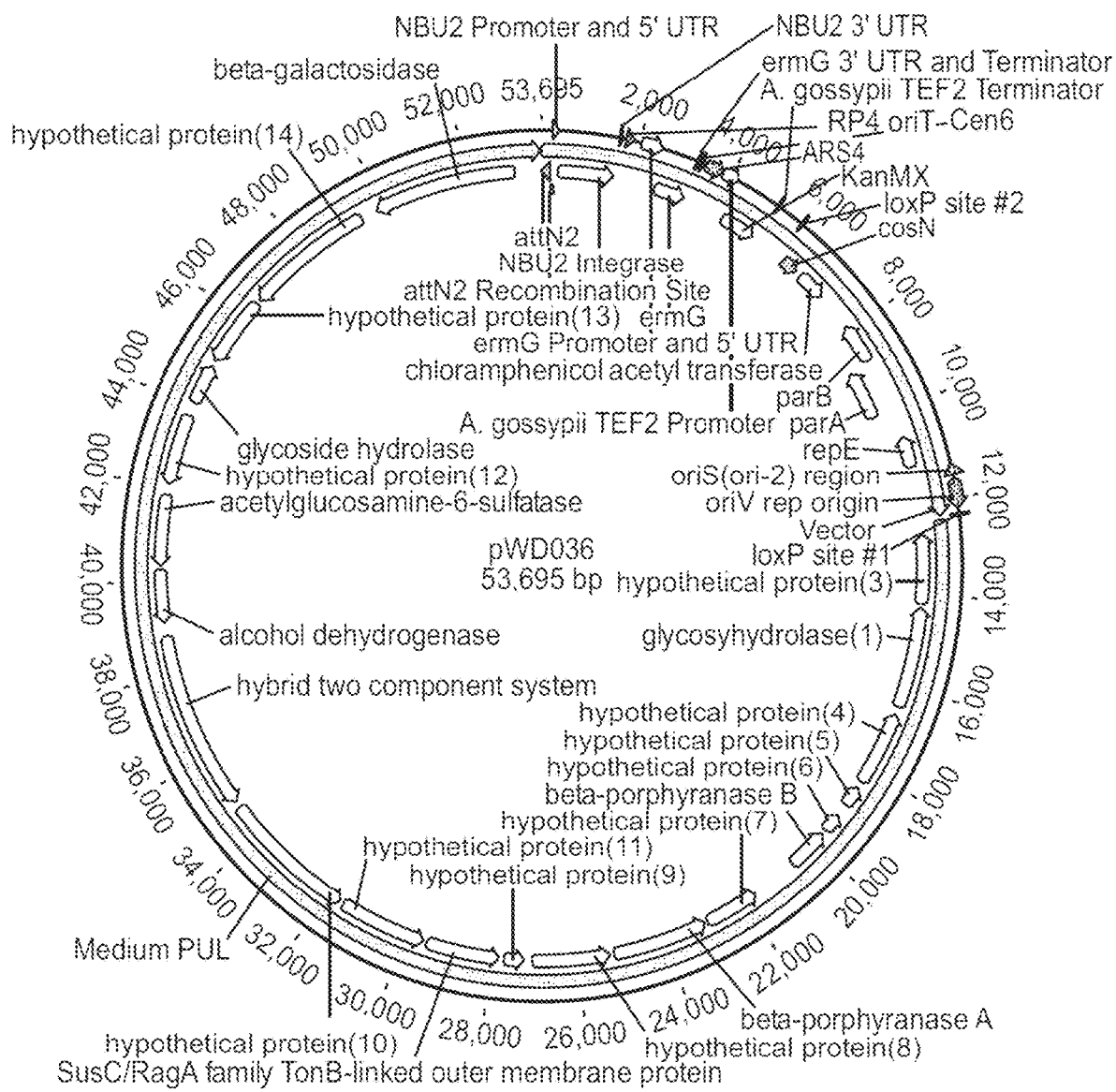
FIG. 5. Map of the medium-length porphyran PUL conjugative plasmid pWD036. The medium-length porphyran PUL genes were cloned from the NB001 genome and are homologs of BACPLE_1683-1706 from the *B. plebeius* genome (see e.g., Tables 5 and 6).
Figure 6:
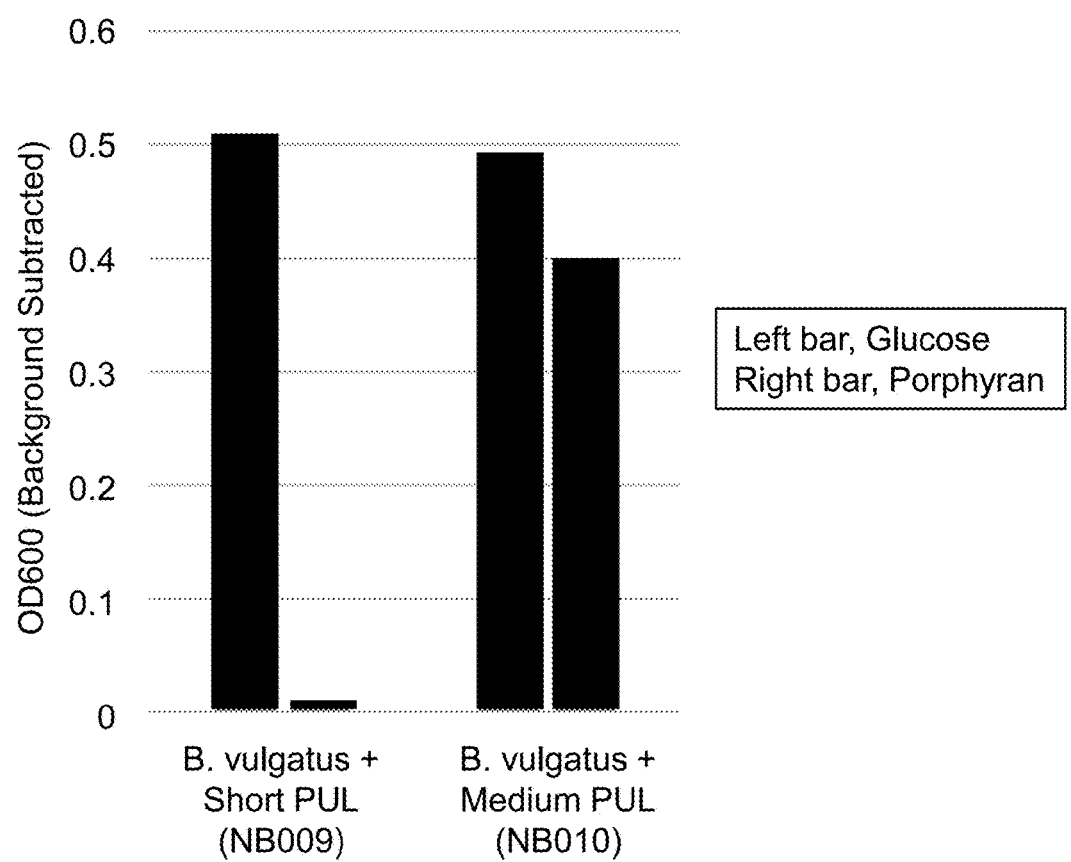
FIG. 6. The medium-length porphyran PUL is sufficient to confer growth on porphyran in *B. vulgatus*. A *B. vulgatus* strain (NB004) containing either the small (pWD037) or medium-length (pWD036) porphyran PUL were grown in minimal media supplemented with either 0.2% glucose (blue) or 0.8% nori extract (orange). End-point cell density measurements are shown. pWD037 contains homologs of BACPLE_1688-1699. pWD036 contains homologs of BACPLE_1683-1706 (see, e.g., Tables 5 and 6).

The porphyran mobile element from NB001 contains an approximately 30 kb deletion relative to the homologous mobile element from *B. plebeius*, suggesting many of the genes in the region are likely not to be involved in porphyran utilization (Figure. 4). To identify a minimal gene set necessary for porphyran utilization, portions of the PUL were synthesized of varying sizes and were integrated into the genome of a *Bacteroides* strain not capable of growth on porphyran (NB004). Initially protocols used previously to transfer a five gene PUL into a *Bacteroides* were followed, but it was found that the much larger porphyran PUL (up to 34 genes and 60 kb) was not compatible with previously described techniques. Instead, the different sized porphyran PULs (FIG. 4) were assembled into a plasmid with components necessary for yeast assembly, *E. coli* conjugation and *Bacteroides* genomic integration (FIG. 5), which was sufficient to integrate correctly assembled porphyran PULs into naive *Bacteroides*. The shortest PUL candidate, containing 10 genes including both of the predicted porphyranases in the PUL, was not sufficient to impart porphyran utilization. However, when expanded to 24 of the 34 total genes, integration of this medium-sized PUL was sufficient to confer growth on porphyran (FIG. 6).

Discussion

Using a privileged niche strategy, an unprecedentedly high colonization level of an introduced strain was obtained in a complex community. Combining two or more privileged niches, potentially using dietary substrates from distinct geographic regions, could further broaden the effectiveness of this strategy to allow robust colonization in the event that one of the two rare substrates is utilized by an individual's endogenous microbiota. Marine carbohydrates (e.g. porphyran, agarose, agaropectin, carrageenan, and marine microbe exopolysaccharides) offer promising substrates to establish a synthetic niche, as they are not typically found in human diets and thus are less likely to be utilized by human gut microbes. As demonstrated in this disclosure, marine bacteria possess utilization genes that can be transferred to gut adapted species. For example, we were able to demonstrate this with the porphyran PUL (SEQ ID NO: 67) and with putative agarose utilization PULs (SEQ ID NO: 68 and 69), which conferred growth on agarose when present natively or when transferred to a naïve strain. Marine carbohydrates are typically easy to extract and generally safe to consume.

This strategy for facilitating robust colonization can facilitate a range of therapeutic applications where it is important to establish a high or a predictable number of natural or engineered therapeutic microbes. For example, it may be important to colonize the gut at a high enough level to ensure that therapeutic activities may overcome competing activities of other microbes. As an example, this may be important when attempting to, for instance, change the short chain fatty acid profile or reduce the accumulation of harmful chemicals that are produced in the gut. Achieving predictable colonization can also be important for therapeutics that must be carefully dosed, such as bacteria with pro- or anti-inflammatory activities which could be used as an adjuvant for cancer immunotherapy or in the treatment of Inflammatory Bowel Diseases. This method of ensuring robust colonization could also be used to displace a harmful species by establishing a non-harmful version that can effectively compete for limiting resources with the harmful strain.

Materials and Methods

Identifying Rare Glycoside Hydrolase Subfamilies 87 fecal metagenomes sequenced by the HMP were downloaded and reprocessed (quality filtered and dynamically trimmed). These metagenomic sequences were then translated to their respective coding sequences and Hidden Markov Models were applied to identify all CAZYmes. The data were normalized to the total count of assigned CAZYme coding sequences per sample.

Porphyran Extraction

Culinary Nori was added to ten times the weight of water and autoclaved for approximately 3 hours. The autoclaved Nori was then strained to remove particulates and then diluted five fold into 100% ethanol and allowed to settle for six hours. This was then centrifuged for 15 minutes at 30,000 g to pellet the precipitate, which was then dried at 80° C.

Isolation of Porphyran and Agarose Utilizing Strains

A *bacteroides* minimal media was prepared as described by Salyers et al (see Salyers et al., Appl. Environ. Microbiol. 33, 319-322 (1977)) with addition of 200 µg/ml Gentamycin and porphyran as 0.8% Nori extract added as the sole carbon source. Primary sewage effluent was collected, settled for approximately two hours and diluted ten-fold into the media, which was then incubated anaerobically for 24 hours at 37° C. The culture was then further diluted 200-fold into the fresh media and incubated another 24 hours anaerobically at 37° C. The saturated culture was then plated as serial dilutions onto Blood-Heart-Infusion media+10% horse blood agar plates and incubated 24 hours anaerobically at 37° C. Colonies were then picked into fresh media, incubated 24 hours anaerobically at 37° C. and prepared for analysis and cryogenic storage.

Assaying Abundance of Porphyran Utilizer in Complex Cultures

An erythromycin resistance cassette was genomically integrated into NB001. The abundance of this strain, NB006, within each complex community could then be easily assessed via selective plating. The eight communities and NB006 were separately grown in rich media, and then NB006 was added to each community at a 1:20 dilution. The complex communities containing NB006 were subsequently grown and diluted 1:1000 daily in rich media either with or without a supplementation of 0.4% Nori extract, a culturing strategy that mimics the requirement for ongoing division necessary to sustain colonization of the gut. To determine the CFU/µL of NB006, 10 µL of each saturated culture was diluted into 200 µL of PBS, further successively diluted 1:10 in PBS seven times, 4 µL of each dilution was spotted onto a plate containing Brain Heart Infusion Blood agar with 200 µg/mL gentamycin and 10 µg/mL erythromycin, and after 24 hours of anaerobic growth at 37° C. colony counts were enumerated. Both significantly increased abundance and reduced variance of NB006 across the eight communities was observed over the course of a week.

Assaying Abundance of Porphyran Utilizer in Mice

To test ability of porphyran to toggle abundance of NB006 in vivo, one group of four male Restricted Flora Swiss-Webster mice (Taconic) were maintained on standard rodent chow (STD diet), while an identical group was given a polysaccharide deficient diet (Bio-Serv, AIN-93G 68% glucose). Both groups were administered approximately $10^{\wedge}8$ CFU of NB006. Abundance of NB006 in the feces was monitored by selective plating on Brain Heart Infusion Blood agar with 200 µg/mL gentamicin and 10 µg/mL erythromycin. Both groups received regular water for five days, 1% porphyran in the drinking water for five days, and then were switched back to regular water for the duration of the experiment.

To test ability of porphyran to allow for stable colonization of a porphyran utilizer into a resistant microbiota, two groups of three male Restricted Flora Swiss-Webster mice (Taconic) were administered NB008, an isogenic strain to NB006 that cannot use porphyran. Abundance of NB008 was monitored by introducing a tetracycline-resistance cassette and selectively plating on Brain Heart Infusion Blood agar with 200 µg/mL gentamicin and 2 µg/mL tetracycline. After one week, both groups of mice received NB006 and one group received 1% porphyran in the drinking water for three days, regular water for seven days, and then 1% porphyran in the drinking water for seven days, until being switched back to and maintained on regular water for the duration of the experiment. Abundance of NB006 was monitored by selectively plating as above with erythromycin selection. Finally, NB008 was re-introduced to mice at day 48 and monitored in the feces.

Genome Sequencing and Analysis

Genomic DNA was isolated from *Bacteroides* strains capable of growth on porphyran (NB001) (SEQ ID NO: 67) or agarose (NB002, NB003) (SEQ ID NO: 68 and 69, respectively) using a PureLink Genomic DNA Mini Kit (Invitrogen). Samples were prepared for multiplexed Illumina sequencing using a Nextera XT DNA Library Preparation Kit (Illumina) and run on an Illumina MiSeq using a 2×150 bp paired-end kit. Approximately 10 million sequencing reads were obtained for each sample. De novo assembly of the reads was performed with the Geneious De Novo Assembler (Biomatters), yielding an average coverage of ~100 reads/bp. Gene annotation and alignment was also performed using Geneious.

Cloning and Transferring the Porphyran Utilization Genes.

Candidate porphyran PUL regions from the conserved mobile element of NB001 were transferred to *Bacteroides vulgatus* (NB004) via a three-step process, which is summarized here and expanded on in the sections below. First, the PUL genes of interest were amplified via PCR and assembled via yeast assembly into a custom shuttle vector capable of propagation in *S. cerevisiae* and *E. coli* as well as conjugation and genomic integration into *Bacteroides* species. Next, correctly assembled plasmids were transferred from yeast to the S17-1 conjugation strain of *E. coli* (see Simon et al., Nat. Biotechnol. 1, 784-791 (1983)) by electroporation. Finally, the plasmids were integrated into the genome of *B. vulgatus* via conjugation and antibiotic selection, followed by sequence-verification using whole genome sequencing.

Design of Porphyran PUL Plasmids

A homolog (71% identity) of a porphyran mobile element was identified in the NB001 genome using the Mauve genome aligner (see e.g., Hehemann et al., Proc. Natl. Acad. Sci. U.S.A. 109, 19786-19791 (2012)). Based on gene annotations and the sequence alignment between these two regions (FIG. 4), three candidate regions of varying sizes (20 kb, 40 kb, and 60 kb) were selected that were predicted to potentially be sufficient to confer growth on porphyran to a naive *Bacteroides* strain. The shortest of these candidate PULs contained homologs of BACPLE_1688-1699 from the *B. plebeius* genome, the medium-sized PUL contained homologs of BACPLE_1683-1706, and the longest PUL contained homologs of BACPLE_1669-1706 (see, e.g., Table 6).

Previously-described techniques for PUL transfer (Sonnenburg et al., Cell 141, 1241-1252 (2010)) were insufficient to move PULs of this size between species. Therefore, a novel PUL transfer strategy was designed that utilized a custom shuttle vector containing a yeast selectable marker and origin of replication, a bacterial artificial chromosome origin and selectable marker for plasmid-based propagation of large DNAs in *E. coli*, a conjugative origin of transfer to enable conjugation from *E. coli* to *Bacteroides* species, as well as an integrase and selectable marker to enable integration into the *Bacteroides* genome. This vector was divided into three precursor fragments with flanking homology such that only upon proper assembly would the vector be capable of propagation in yeast (Tables 3 and 4). The first fragment (Vector_01) was an AscI digestion of pWD011, which was custom built to contain all *Bacteroides*-specific machinery as well all yeast vector components aside from a portion of the KanMX selectable maker. The remainder of the KanMX marker was supplied via the PCR product Vector_02, which also served to bridge Vector_01 and Vector_03. Vector_03 was an AscI digest of pWD012, which was derived from a blunt religation of the commercially-available pEZ-BAC vector (Lucigen). The PUL candidates were divided into multiple 6 kb fragments to be used in a yeast assembly reaction (Tables 3 and 5), and PCR primers were designed such that neighboring fragments would share ~200 bps of homology (Table 2).

TABLE 2

List of oligonucleotides used to build the porphyran PUL plasmid

| ID | Sequence | SEQ ID NO: |
|---|---|---|
| AA34 | GGGTACAGAAAATCTCGGTC | 35 |
| AA35 | TTCATCATGTCGTACGAAGG | 36 |
| AA36 | TACTTCCATTTGGGGTGAAG | 37 |
| AA37 | TACAGTCCCTTTGGACAATG | 38 |
| AA38 | CATACTTTAGCATCGTCGAAAAG | 39 |
| AA39 | TTTCCATTTCCAGGATTCCC | 40 |
| AA40 | GTAGCTCCGGTGACATTTAC | 41 |
| AA41 | TCTTTAGCTGAAGAAACGGC | 42 |
| AA42 | AAGCTTGCGTATGTCGATAG | 43 |
| AA43 | TTATCGCCATTCTTCAGCAG | 44 |
| AA44 | TGGCATCCGACGAATATAAG | 45 |
| AA45 | TTTGGAATAGGCCAGTATGC | 46 |
| AA46 | AGGTAAAGGCACTGTTTTCC | 47 |
| AA47 | ATATAGCCGGAGATTCTCCG | 48 |
| AA48 | CATCTACATCATGTCGGACG | 49 |
| AA49 | CTGTCCGGTCATGATACATG | 50 |
| AA50 | GATTCTCTTGGGGACAGAAC | 51 |
| AA51 | AGTTTCCCATTTCACGTCTG | 52 |

TABLE 2-continued

List of oligonucleotides used to build the porphyran PUL plasmid

| ID | Sequence | SEQ ID NO: |
|---|---|---|
| AE30 | ATTTATCTATCCATTCAGTTTGATTTCTCAGG ACTTTACATCGTCCTGAAAGTATTTGTTttttggg tgttgatatggcag | 53 |
| AE31 | ATTTATCTATCCATTCAGTTTGATTTCTCAGG ACTTTACATCGTCCTGAAAGTATTTGTTaatcc caatacagtctgttactg | 54 |
| AE45 | GTGAGTTGATTGCTACGTAAATAACTTCGTA TAGCATACATTATACGAAGTTATGGACTAcgc aggtcaatatccggaa | 55 |
| AE46 | GTGAGTTGATTGCTACGTAAATAACTTCGTA TAGCATACATTATACGAAGTTATGGACTAggta aacctccccgatgg | 56 |
| AE47 | GTGAGTTGATTGCTACGTAAATAACTTCGTA TAGCATACATTATACGAAGTTATGGACTAtttag aacatattttccgatttgccag | 57 |
| AE49 | AAACAGCATTCCAGGTATTAGAAG | 58 |
| AE50 | CACTGCCCGCTTTCCAGTCGGGAAACCTGT GCGGCCGCTTTCCTTCTTTCTCTCTTCTGGc agtatagcgaccagcattc | 59 |

TABLE 3

List of PCR products used to build the porphyran PUL plasmids.

| ID | Length (bps) | Primer 1 | Primer 2 | Template | SEQ ID NO: |
|---|---|---|---|---|---|
| PCR_01 | 6,220 | AA35 | AA36 | NB001 Genomic DNA | 71 |
| PCR_02 | 6,280 | AA37 | AA38 | NB001 Genomic DNA | 72 |
| PCR_03 | 6,247 | AA39 | AA40 | NB001 Genomic DNA | 73 |
| PCR_04 | 6,169 | AA41 | AA42 | NB001 Genomic DNA | 74 |
| PCR_05 | 6,232 | AA43 | AA44 | NB001 Genomic DNA | 75 |
| PCR_06 | 6,187 | AA45 | AA46 | NB001 Genomic DNA | 76 |
| PCR_07 | 6,185 | AA47 | AA48 | NB001 Genomic DNA | 77 |
| PCR_08 | 6,178 | AA49 | AA50 | NB001 Genomic DNA | 78 |
| PCR_09 | 6,162 | AE45 | AA34 | NB001 Genomic DNA | 79 |
| PCR_10 | 6,138 | AA51 | AE30 | NB001 Genomic DNA | 80 |
| PCR_11 | 5,359 | AE46 | AA40 | NB001 Genomic DNA | 81 |
| PCR_12 | 4,638 | AE47 | AA42 | NB001 Genomic DNA | 82 |
| PCR_13 | 3,524 | AA47 | AE31 | NB001 Genomic DNA | 83 |
| Vector_02 | 769 | AE49 | AE50 | KanMX (SEQ ID NO: 70) | 84 |

TABLE 4

List of digests used to build the porphyran PUL plasmids.

| ID | Length (bps) | Plasmid | Restriction Enzyme |
|---|---|---|---|
| Vector_01 | 4,730 | pWD011 (SEQ ID NO: 64) | AscI |
| Vector_03 | 7,234 | pWD012 (pEZ-BAC) (SEQ ID NO: 65) | AscI |

TABLE 5

List of porphyran PUL plasmids.

| Plasmid Name | Description | Length (bps) | Parts used in yeast assembly |
|---|---|---|---|
| pWD035 (SEQ ID NO: 66) | Long Porphyran PUL | 72,558 | PCR_01, PCR_02, PCR_03, PCR_04, PCR_05, PCR_06, PCR_07, PCR_08, PCR_09, PCR_10, Vector_01, Vector_02, Vector_03 |
| pWD036 (SEQ ID NO: 63) | Medium Porphyran PUL | 53,695 | PCR_04, PCR_05, PCR_06, PCR_07, PCR_08, PCR_10, PCR_11, Vector_01, Vector_02, Vector_03 |
| pWD037 (SEQ ID NO: 62) | Short Porphyran PUL | 32,364 | PCR_05, PCR_06, PCR_12, PCR_13, Vector_01, Vector_02, Vector_03 |

Yeast Assembly of Porphyran PUL Plasmids

All fragments were prepared for yeast assembly via PCR with NEB Q5 polymerase (Table 3) or restriction digest with AscI from NEB (Table 4). Cleanup reactions were performed with a Zymo Clean and Concentrator kit, and the resulting DNA concentrations were measured using a Nanodrop 1000 (Thermo Scientific). Yeast assembly of plasmids pWD035-37 (Table 5) was carried as described (see, e.g., Chandran et al., Methods Mol. Biol. 1472, 187-192 (2017)), using 100 fmols of each part in a lithium acetate transformation of the S. cerevisiae strain BY4741. After rescuing the transformed cells for 1 hour at 30° C. in YPD media, cells were plated on YPD plates supplemented with G418 (200 μg/ml). After incubation for 48 hours at 30° C., colonies were grown up in YPD+G418 and screened for successful plasmid assembly using colony PCR. Approximately 90% of screened clones appeared to contain a correctly assembled plasmid.

Transfer of Porphyran PUL Plasmids from Yeast to E. coli

Yeast strains harboring properly assembled plasmids were back diluted 1:100 into YPD+G418 and grown at 30° C. for 6 hours to an OD of 2.500 μl of each culture was transferred to a microcentrifuge tube, centrifuged, and resuspended in 100 μl of PBS buffer. The cell mixture was then vortexed alongside ~50 0.5 mm glass disruptor beads (USA Scientific) for 5 minutes to lyse the cells. 5 μl of the lysate was used in an electroporation of 100 μl of electrocompetent S17-1 E. coli. Transformations were rescued for 1 hour in LB media with shaking at 37° C. and then plated onto agar plates with LB+ampicillin (100 μg/ml). For large plasmids, fewer than 20 colonies were often obtained from a single electroporation. Colonies were grown up in LB+ampicillin and screened for successful plasmid transfer via colony PCR.

Conjugation of Porphyran PUL Plasmids into B. vulgatus

The PUL plasmids were then transferred from S17-1 E. coli into the genome of an environmental isolate of B. vulgatus (NB004). It was observed that larger plasmids resulted in fewer conjugants on erythromycin-selective plates, with the largest plasmid (pWD035) not yielding any successful plasmid integrants. Despite this size bias, both pWD036 and pWD037 were successfully integrated into NB004 as verified by whole genome sequencing of the resulting strains.

In Vitro Growth Assays

Strains were grown overnight anaerobically at 37° C. in a tryptone-yeast extract-glucose (TYG) medium to saturation. Saturated cultures were diluted 1:50 into Salyer's Minimal Media supplemented with either 0.2% glucose or 0.8% porphyran extract. The diluted cultures were grown anaerobically at 37° C. for 12 hours, and 100 μL of each culture was transferred to a 96-well microtiter plate. The optical density at 600 nm of each culture was measured using a Wallac Victor 2 1420 Multilabel Counter. OD600 readings were normalized by subtracting out the background detected when media lacking cells was measured.

Example 2

Synthetic Niche Generation Enables Strain Integration in the Gut Microbiota

The dense microbial ecosystem in the gut is intimately connected to numerous facets of human biology, and manipulation of the gut microbiota has broad implications for human health. In the absence of profound perturbation, the abundance of bacterial strains that reside within an individual is largely stable over time. In contrast, the fate of exogenous commensal and probiotic strains applied to an established microbiota is variable, largely unpredictable, and greatly influenced by the background microbiota.

In this example, a synthetic metabolic niche was generated via administration of a privileged nutrient source, and reliable integration of an exogenous *Bacteroides* strain at predictable abundances into mice harboring diverse communities of gut microbes was demonstrated. Dietary marine polysaccharides not accessible to other members of the gut community, but utilized by the introduced strain facilitated predictable engraftment and boosted abundance by more than three orders of magnitude, independent of background microbiota. This targeted dietary support was sufficient to overcome priority exclusion by an isogenic strain, and facilitated strain replacement. Transfer of this privileged nutrient-utilization system into a naïve strain of *Bacteroides* is demonstrated, and finely tuned control of strain abundance in the gut by varying polysaccharide input is shown. The data presented here highlight the influence of nutrient availability in shaping microbiota membership, expand the ability to perform a broad spectrum of methods in the context of a complex microbiota, and facilitate cell-based therapeutic strategies in the gut.

Results and Discussion

Changes to the microbial membership of the highly competitive and dynamic gut microbiota can impact numerous aspects of host biology. Despite the importance of gut microbe composition in human health, the rules governing invasion of commensal strains into an existing complex community are not well understood. Resident strains often appear to exclude similar invading strains although in some cases, the opposite is true: the niche occupied by existing strains can be exploited by a similar invading strain. The inability to predict or control the outcome of fecal microbiota transplants illustrates the need for basic insight into the factors that influence whether new strains of bacteria can integrate into a pre-existing, complex microbiota.

Figure 7A:
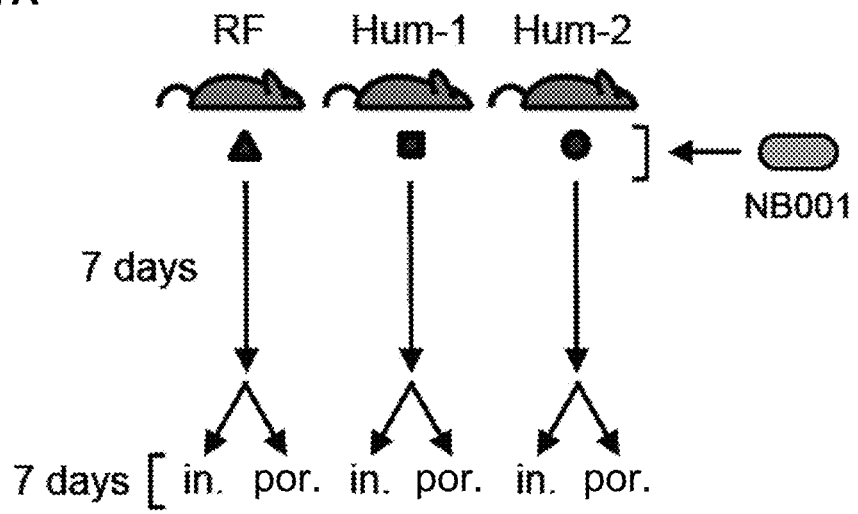
FIG. 7A-FIG. 7D. Niche availability varied by microbiota and could be modulated by addition of a privileged nutrient.
Figure 7B:
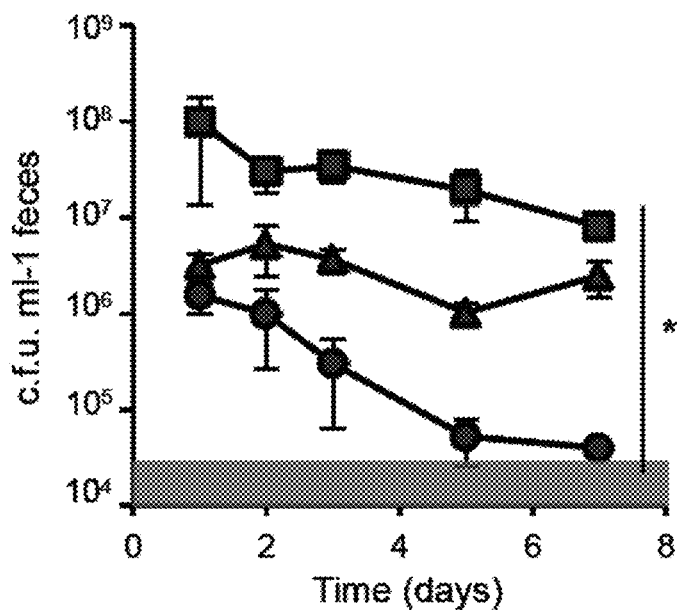
Figure 10A:
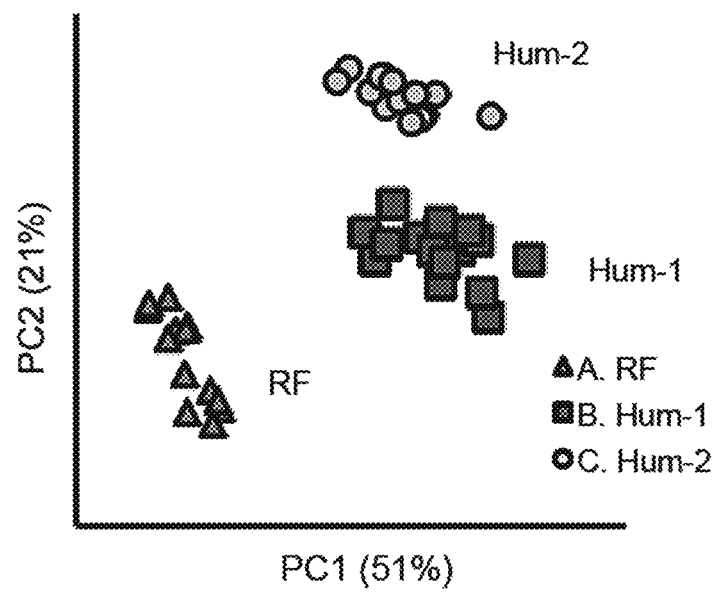
FIG. 10A-FIG. 10B. Three model background communities of gut microbes were distinct from each other.
Figure 10B:
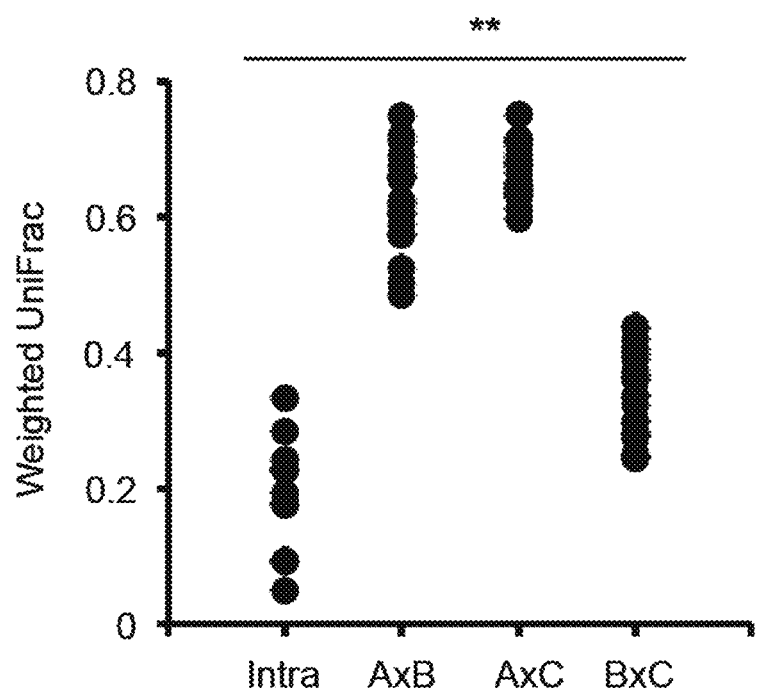

To characterize the extent to which incoming exogenous bacteria variably colonize hosts with distinct microbiotas, mice harboring a conventional mouse microbiota were used as were two groups of ex-germ free mice, each colonized with the gut microbiota from two different healthy human donors from the United States ("humanized") as model hosts. These three groups of mice were administered a strain of *Bacteroides ovatus* (NB001), a prominent gut commensal species, which was modified genetically, adding erythromycin resistance and GFP-expression cassettes for tracking purposes. NB001 was monitored by colony forming units (c.f.u.) in feces via selective plating, and colonies were verified by GFP-fluorescence (see Methods) over the course of seven days (FIG. 7a). The different communities (FIG. 10) varied in their ability to integrate NB001 (FIG. 7b), and one human microbiota was resistant to colonization, with all mice in the group exhibiting decreased abundance of the challenge strain over the seven day period.

Figure 7C:
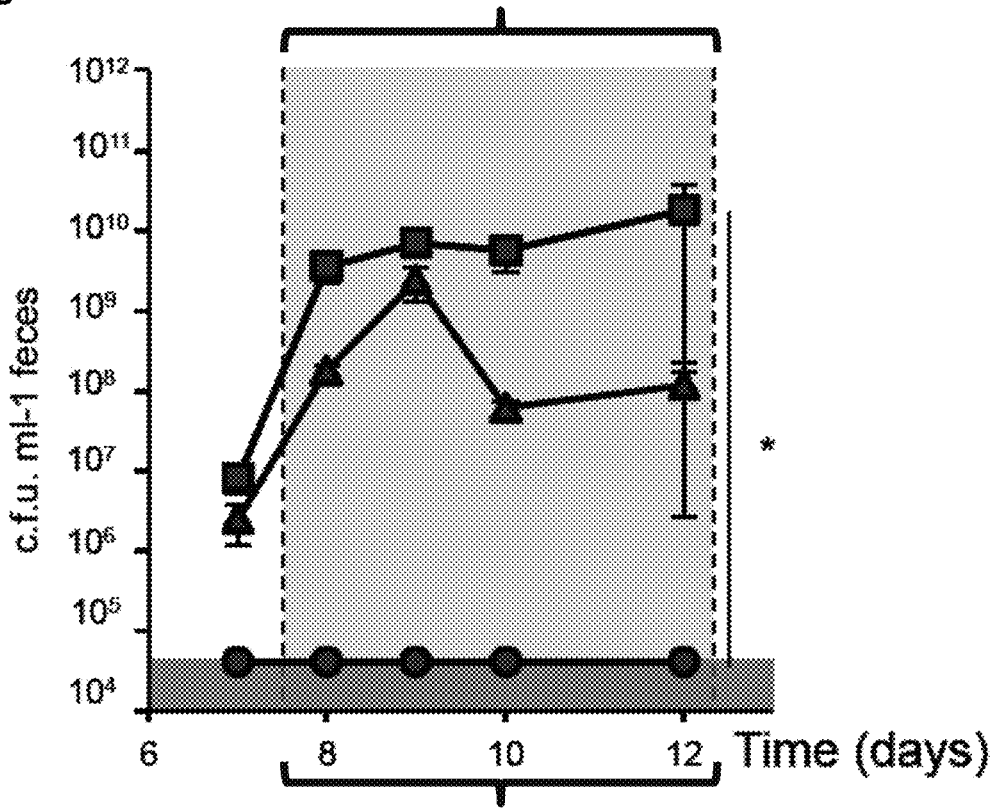
Figure 11A:
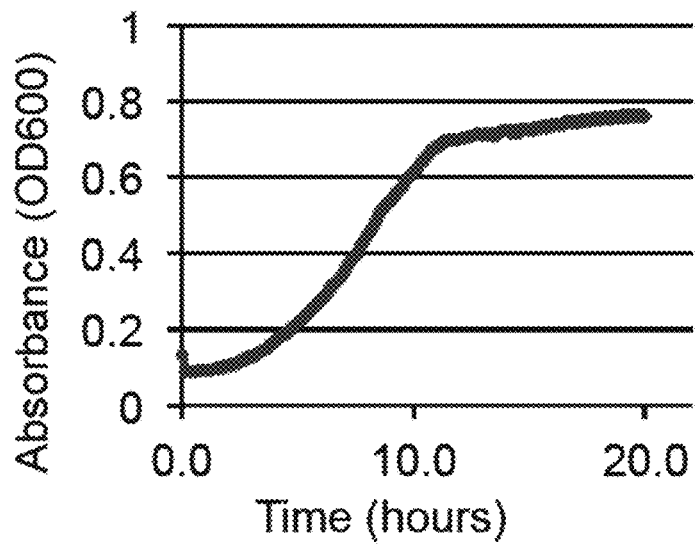
FIG. 11A-FIG. 11C. NB001 can utilize both inulin and porphyran extract as sole carbon sources for growth. NB001 demonstrates growth in minimal media with only one specified carbon source, either (FIG. 11A), glucose (doubling time=157 minutes), (FIG. 11B), inulin (doubling time=127 minutes), or (FIG. 11C), porphyran extract (doubling time=98 minutes).
Figure 11B:
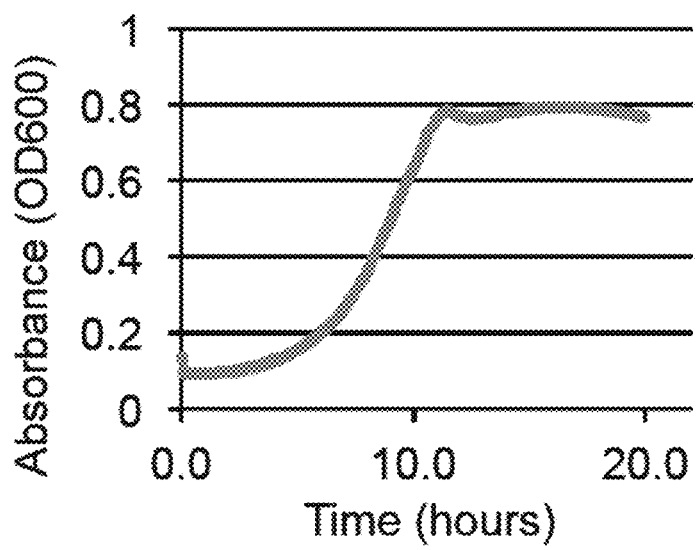

Inulin was then administered to the three aforementioned groups of mice seven days after inoculation with NB001, which grows at a similar rate in vitro in a minimal medium containing either glucose or inulin as the sole carbohydrates (MM-glucose doubling time=157 min; MM-inulin doubling time=127 min; FIG. 11b). Over seven days of feeding an inulin-based diet (10% inulin w/v) to these three groups of mice, NB001 exhibited highly variable responses across the background microbiotas (range of mean c.f.u. per ml in feces $<4*10E4$ to $2*10E10$; FIG. 7c). This variability may be due to several factors that differentiate the three microbiotas including the varying degrees of competition from other community members for this MAC, common in the Western diet.

Figure 7D:
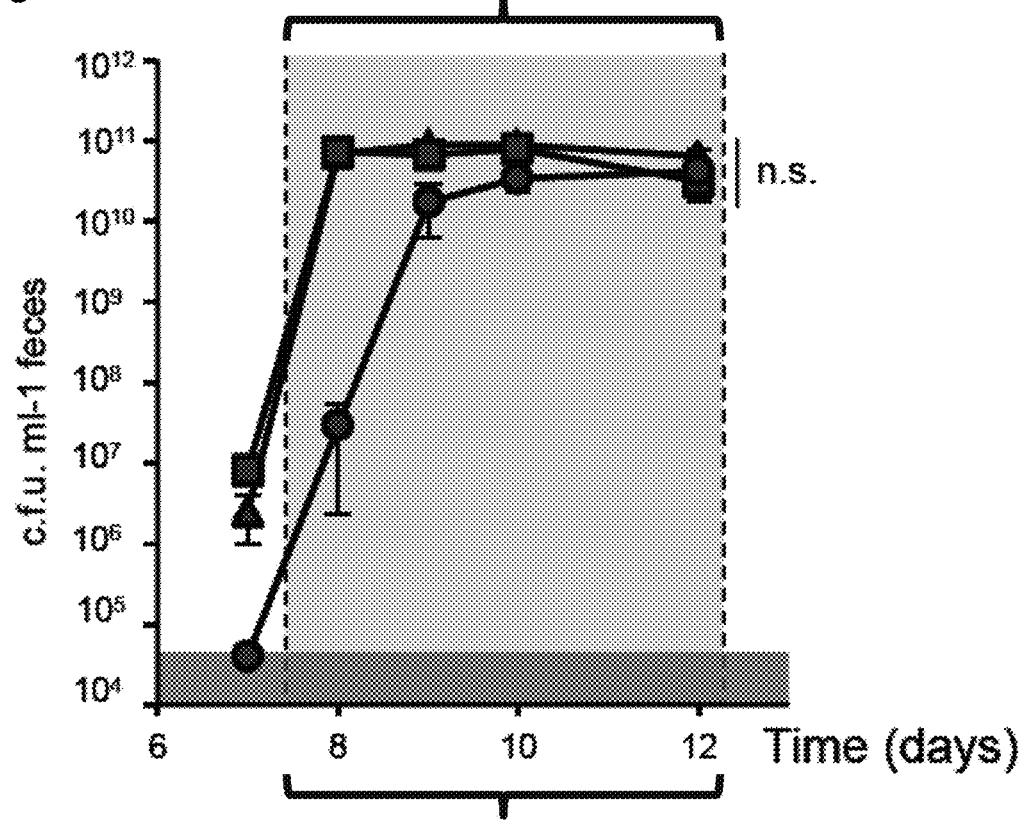
Figure 11C:
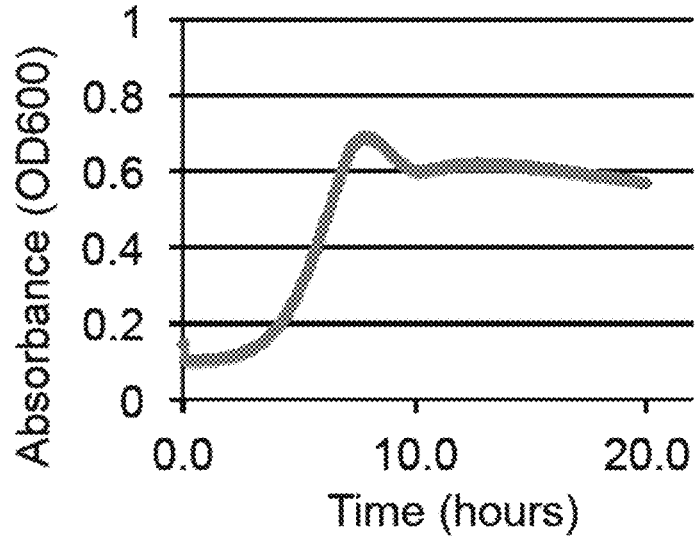

In contrast, microbiota utilization of the non-ubiquitous seaweed polysaccharide porphyran, found in the seaweed *Porphyra yezoensis* used to prepare culinary nori, is much less common in US microbiotas. The consumption of porphyran by some *Bacteroides* species can be facilitated by a horizontally-transferred PUL, which originated in marine bacteria. We hypothesized that this exotic dietary MAC would create a privileged niche within the gut and promote integration of an exogenous strain competent in its use. NB001 was capable of growth on porphyran in vitro (doubling time=98 min; FIG. 11c), and so a custom nori diet (10% dried *Porphyra yezoensis* w/v) was administered to the three groups of mice seven days after inoculation with NB001. Indeed, in response to nori in the diet a robust increase in abundance of NB001 was observed, irrespective of background microbiota. Additionally, the variability in colonization levels across communities was eliminated (range of mean c.f.u. per ml in feces $3*10E10$ to $6*10E10$; FIG. 7d), indicating specificity of an exotic nutrient source and cognate utilization system to promote bacterial growth in vivo. Access to nori substrates rescued NB001 from below the limits of detection in the most resistant microbiota and boosted its abundance to levels indistinguishable from those achieved in the other two microbiotas (FIG. 7d). Together these data suggest a powerful approach to reproducibly control strain integration independent of the background microbiota, and implicate nutrient availability as a key modulator of strain integration into the gut community.

Figure 8A:
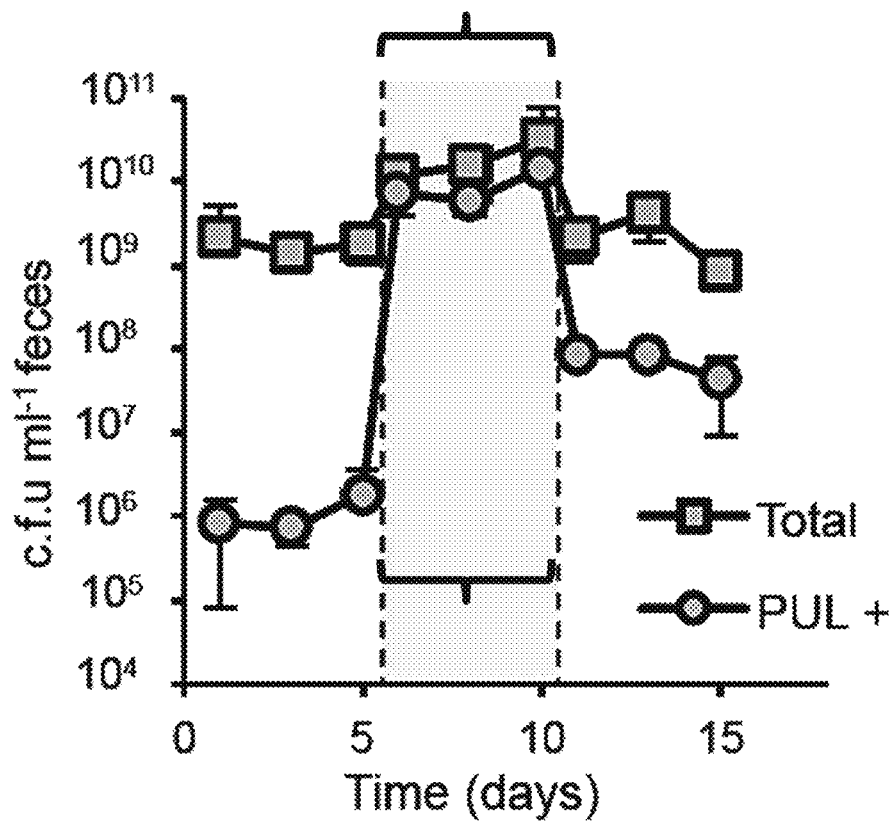
FIG. 8A-FIG. 8F. Access to a privileged nutrient mediated population size and overcame isogenic self-exclusion. Density of NB001 (PUL+), NB001 lacking the ability to utilize porphyran (PUL−), and total culturable anaerobes (Total) in feces of conventional mice. Periods of administration of porphyran extract in drinking water indicated by brackets/dotted lines (panels a-c: 1% w/v, panels d-f: 0.1% w/v).
Figure 8B:
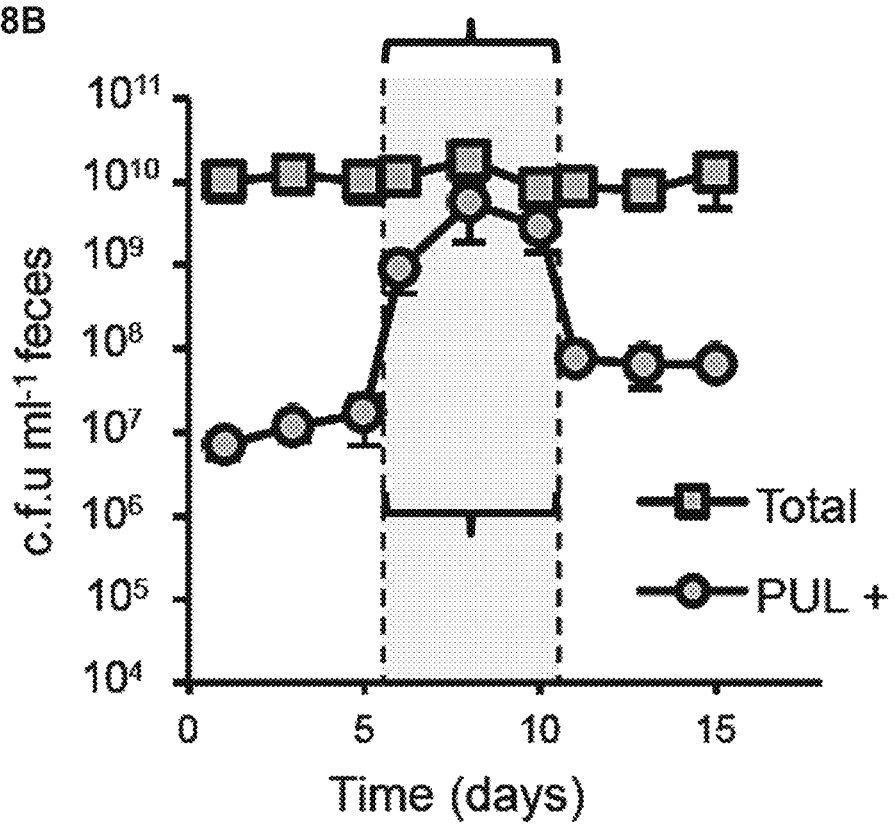
Figure 8C:
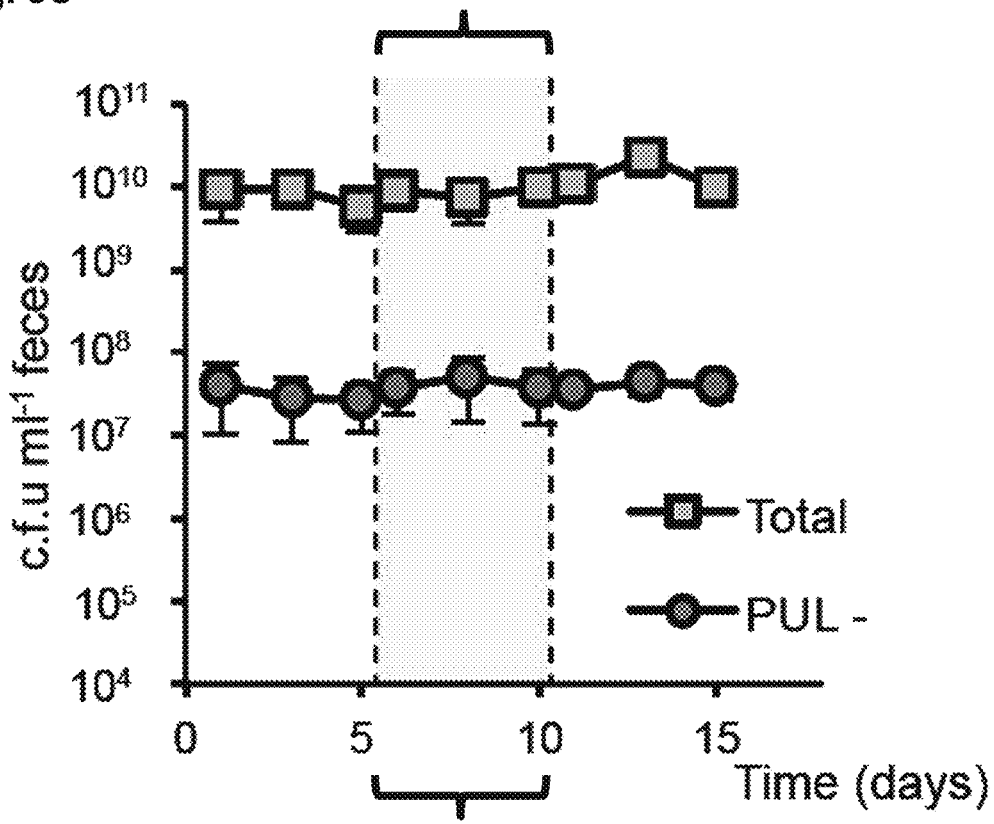
Figure 9A:
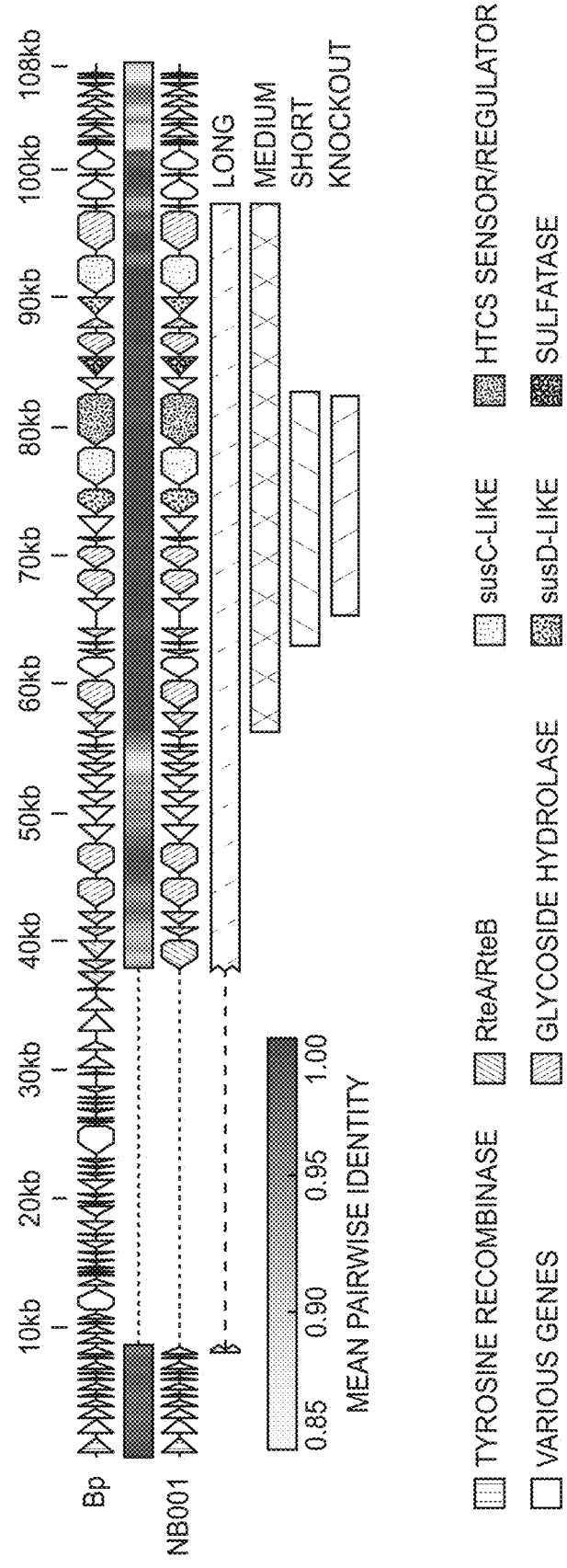
FIG. 9A-FIG. 9E. Control over population size was engineered, and was highly tunable.
Figure 9B:
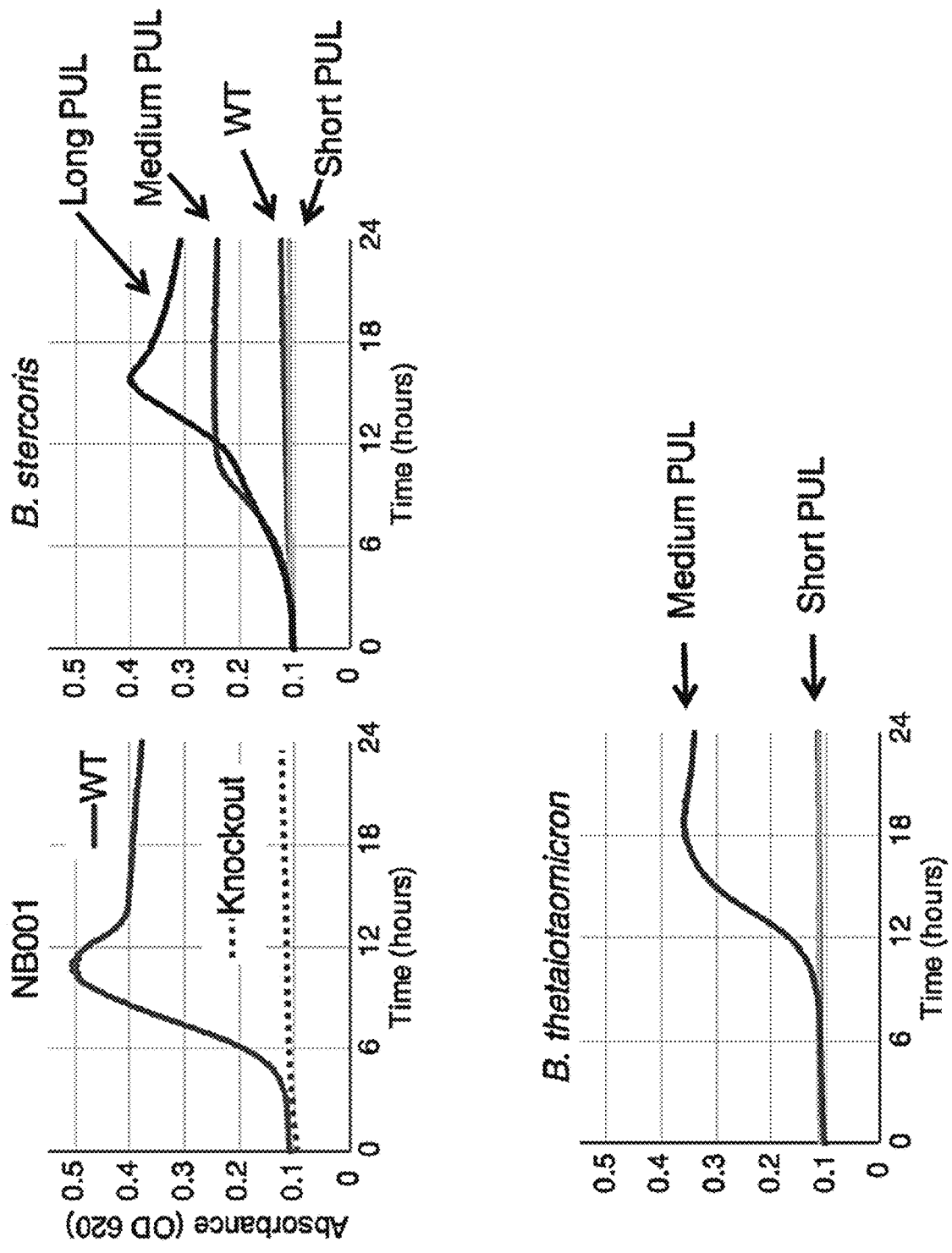

Given the context independence of strain integration via access to nori polysaccharides, it was next tested whether the population size could be toggled by addition and removal of the substrate in vivo. Conventional mice were colonized with NB001 and c.f.u. in feces was tracked. The mice were switched in five day intervals between regular water, water with 1% porphyran extract, and a regular water washout. To test the influence of competing polysaccharides in the diet, this experiment was performed on both standard, MAC-rich chow and a MAC-deficient chow that provides no exogenous polysaccharides to the microbiota. In both dietary contexts, with or without other competing dietary MACs, NB001 responded robustly to introduction of marine polysaccharides, showing a large and highly reproducible increase in abundance of four orders of magnitude in the absence of dietary MACs (FIG. 8a) and three orders of magnitude in the presence of diverse dietary MACs (FIG. 8b). This response was contingent upon access to porphyran, as deletion of eight genes required for its metabolism abolished the effect (FIG. 8c, FIG. 9a, 9b). Additionally, the extract alone did not significantly affect the composition of the background microbiota (FIG. 12), further supporting the lack of porphyran use by members of the background community.

Figure 8D:
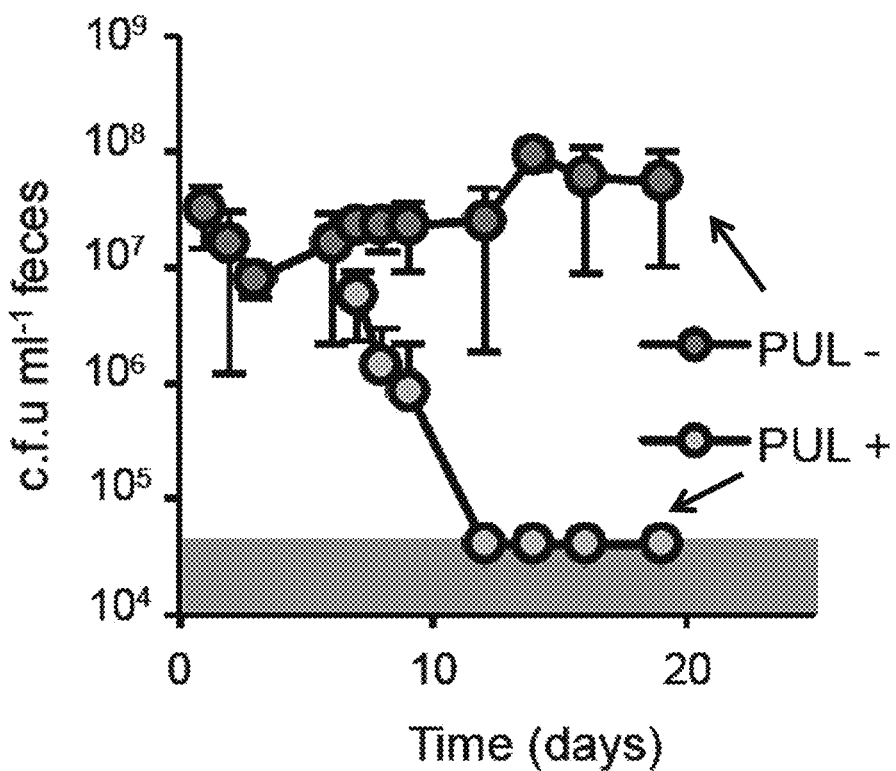
Figure 8E:
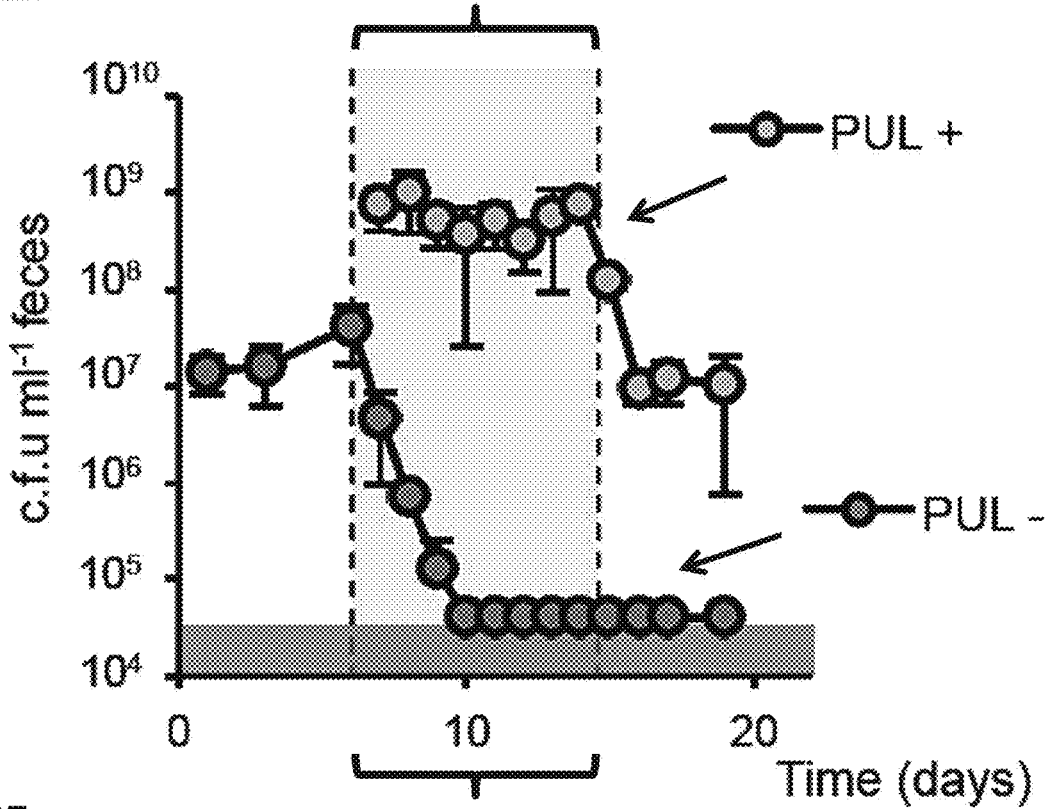
Figure 8F:
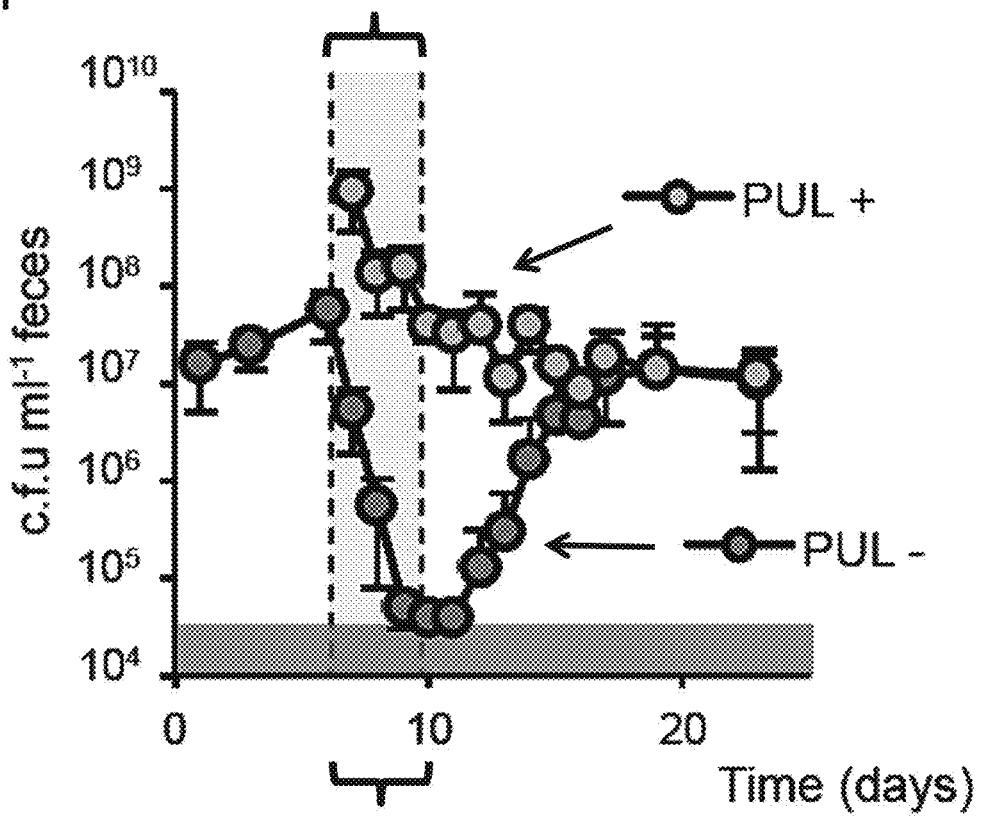
Figure 13A:
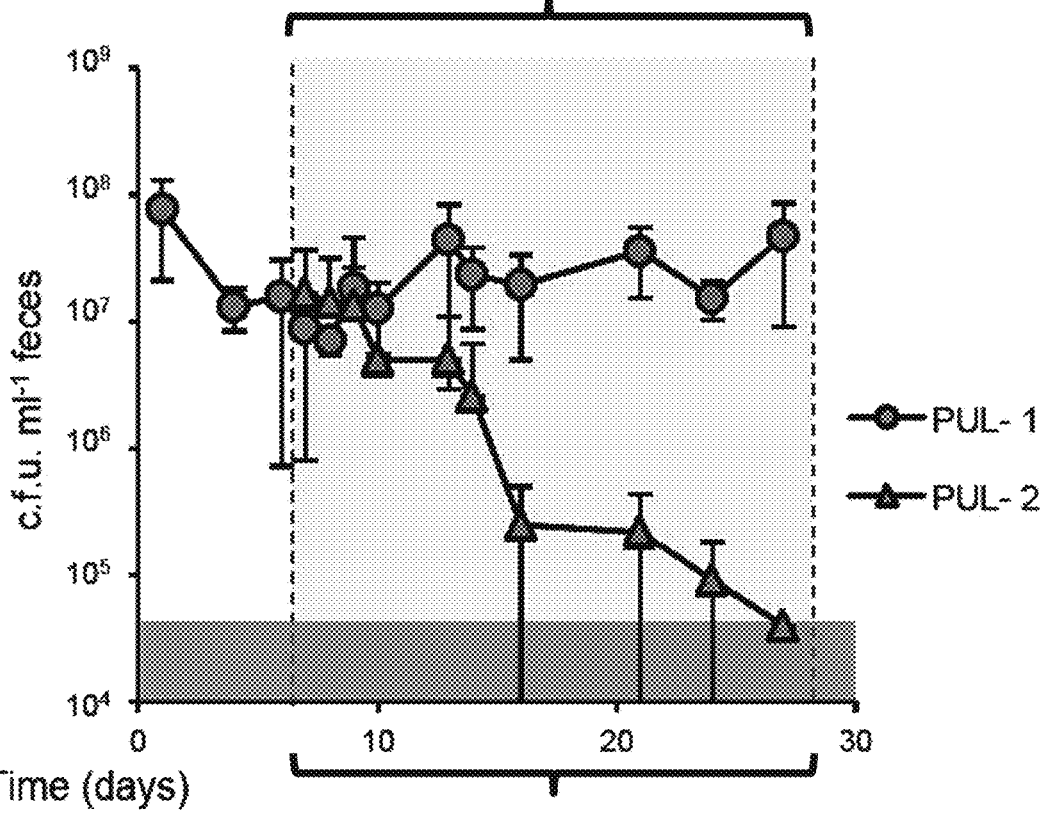
FIG. 13A-FIG. 13B. Primary colonizer displacement was robust and contingent upon access to porphyran.
Figure 13B:
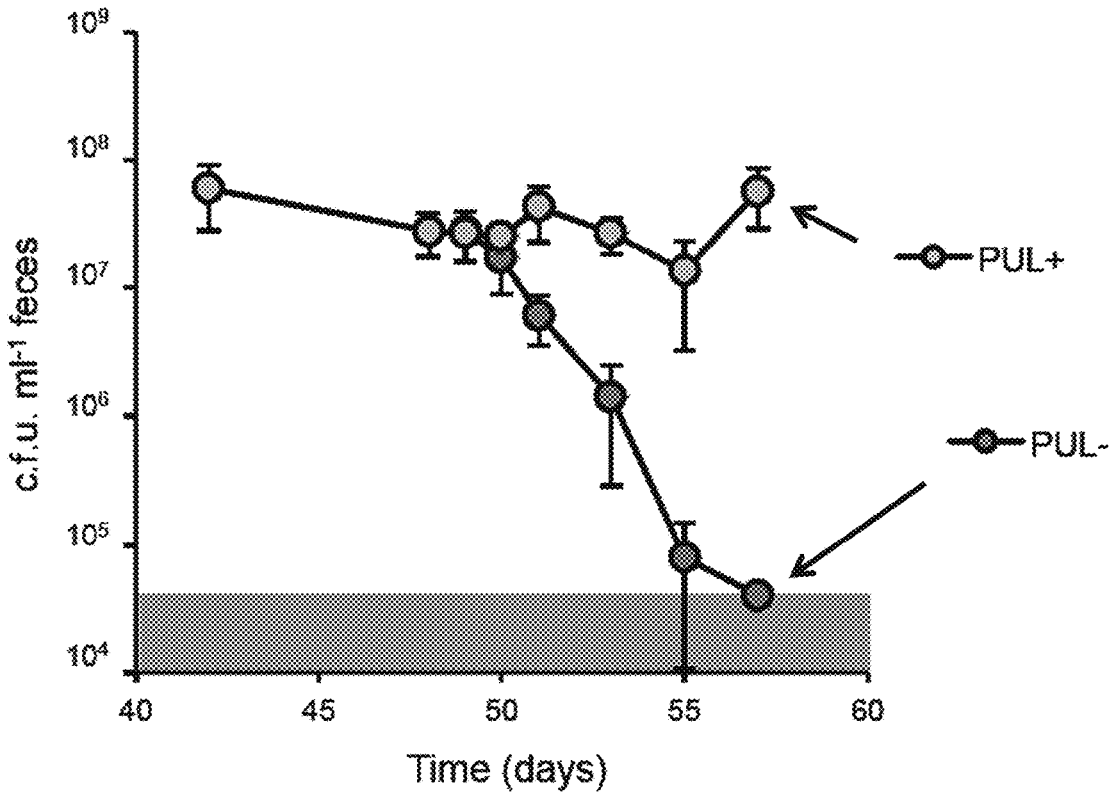

Bacteroides species engage in interesting colonization behavior in which an early colonizer will exclude a challenging isogenic strain, the phenomenon known as priority effects in the ecological literature. We hypothesized that this behavior, though previously demonstrated in gnotobiotic mice, would also occur in the context of a complex community, and that it could be overcome by providing a privileged nutrient to the challenging strain to create a distinct metabolic niche. Indeed, an early-colonizing NB001 strain excluded an NB001 challenge strain in conventional mice (FIG. 8d). Supplementing porphyran in the diet, accessible only to the challenging strain, allowed the challenging strain to overcome the priority effect, and resulted in displacement of the early colonizer by the challenging strain (FIG. 8e). Replacement of the early-colonizing strain required that the challenging strain have access to porphyran (FIG. 13), and displacement was robust to subsequent challenge by the original colonizer (FIG. 13). Interestingly, when porphyran was supplemented for shorter periods of time, replacement of the original strain was incomplete: the early-colonizer recovered from below the levels of detection and co-existed with the secondary colonizer after cessation of porphyran administration (FIG. 8f).

Figure 9C:
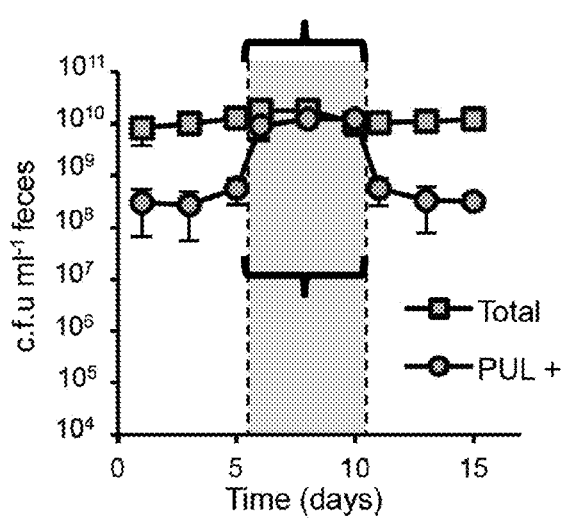

The genome of NB001 was sequenced and the polysaccharide utilization locus (PUL) was identified (FIG. 9a). Three different length PULs were constructed, ranging from 10 to 34 of the genes (20-60 kb) from the full-length PUL (FIG. 9a). Previous methods to transfer a five gene PUL were not sufficient for these much larger constructs, and so the constructs were assembled in yeast before transferring to conjugative E. coli, and the constructs were integrated into the chromosome of two target strains unable to utilize porphyran for growth, Bacteroides stercoris and Bacteroides thetaiotaomicron. Transfer of the shortest PUL was insufficient to impart growth on porphyran to either naïve species of Bacteroides tested (FIG. 9b), but the medium PUL allowed for growth in vitro (FIG. 9b). A significant drop-off in conjugation efficiency was observed with the long PUL, and only B. stercoris yielded transconjugants, suggesting inter-species differences in amenability to accepting large pieces of foreign DNA. When colonized into conventional mice, abundance of B. thetaiotaomicron harboring the medium length PUL could be toggled up and down through addition of porphyran extract in the water (FIG. 9c).

Figure 9D:
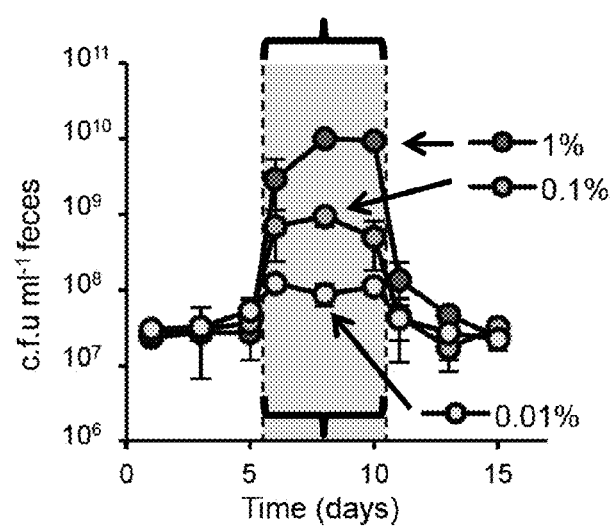
Figure 9E:
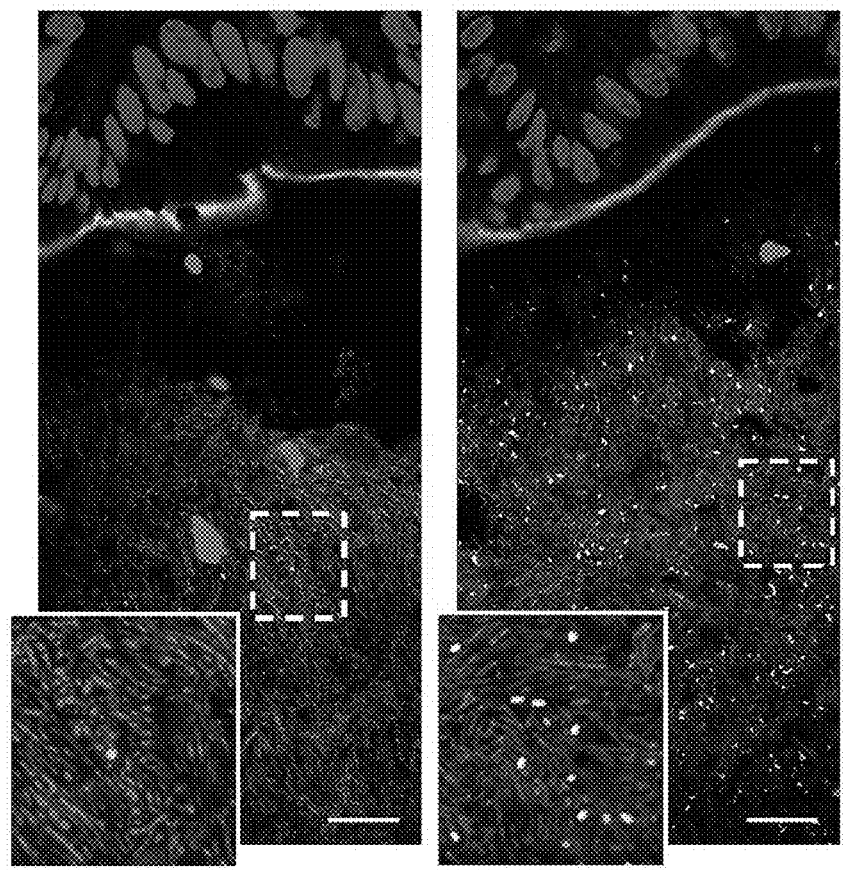

Finally, the tunability of strain abundance was assessed by varying the porphyran supplemented in diet. Conventional mice were colonized with a GFP fluorescent NB001 strain and c.f.u. in the feces was tracked for five days. 1%, 0.1%, or 0.01% weight by volume porphyran extract was then administered in the drinking water for five days, followed by a subsequent five-day washout with regular water. A ten-fold decrease in abundance of NB001 in the feces was observed with each ten-fold dilution of extract administered in the water (FIG. 9d), indicating fine control over strain abundance through modulation of the porphyran concentration. To visually assess the spatial distribution and abundance of NB001 in vivo in the presence of different amounts of porphyran, frozen tissue sections were prepared and endogenous GFP of the NB001 strain was imaged via confocal microscopy. A substantial increase in GFP-positive cells was seen when comparing mice given 0.01% vs. 1% extract (FIG. 9e).

Predicting amenability of a given community to the introduction of a new strain is a challenge given the diverse and divergent features of different individuals' pre-existing microbiotas, including whether or not it is already inhabited by a strain capable of excluding the one being introduced. The results presented in this example demonstrate that privileged nutrient sources such as porphyran can modify resource partitioning in the gut microbiota, and systems such as those presented here can be deployed to enhance human health.

Methods

Bacterial Culture and Strain Isolation

All bacterial growth was performed at 37° C. under anaerobic conditions. Growth for introduction into mice was performed in rich media (tryptone-yeast-glucose) with no antibiotics added. Growth curves and selective growth on nori extract were performed in Salyers Minimal Media (SMM 100 mL in $dH_2O$: 0.1 g $(NH_4)_2SO_4$, 0.1 g $Na_2CO_3$, 0.05 g L-cysteine, 10 mL 1M $KPO_4$ pH7.2, 5 mL Mineral Salts (1 L in $dH_2O$: 18 g NaCl, 0.53 g $CaCl_2*2H_2O$, 0.4 g $MgCl_2*6H_2O$, 0.2 g $MnCl_2*4H_2O$, 0.2 g $CoCl_2*6H_2O$), 1 mL 0.4 mg/mL $FeSO_4$, 0.1 mL 1 mg/mL Vitamin $K_3$, 0.1 mL Histidine/Hematin*, 0.05 mL 0.01 mg/mL Vitamin $B_{12}$) with carbon source added to a final concentration of either 0.2% (FIG. 9b, glucose), 0.5% (FIG. 11), or 0.8% (FIG. 9b, nori extract) weight by volume and filter sterilized. SMM was either made fresh the day of the experiment, or prepared without histidine/hematin or L-cysteine and stored at 4° C. for up to four weeks, with the missing components added the day of the experiment.

C.f.u. were cultivated on brain-heart infusion blood agar (BHI-BA) with appropriate selective antibiotics (200 μg/mL gentamycin, and 25 μg/mL erythromycin or 2 μg/mL tetracycline), or on SMM agar plates (for GFP visualization, 2×SMM tempered to 50° C.+ equal volume 3% agar tempered to 50° C.) with selective antibiotics.

NB001 (porphyran MAC utilizing B. ovatus) and NB004 (naïve B. stercoris) were isolated from primary waste effluent at the San Jose Wastewater Treatment Facility via selection in liquid culture (SMM) with 200 ug/mL gentamycin (as Bacteroides are naturally gentamycin resistant*), and for NB001, growth on 0.8% nori extract. Briefly, settled primary effluent was diluted ten-fold into SMM and grown as above for 24 h, subcultured at 1:200 into fresh media and grown for 24 h, and plated in serial dilutions onto BHI-BA. Single colonies were picked into SMM for growth confirmation, cryogenic storage, and downstream analysis. A GFP-expressing, erythromycin-resistant variant of NB001 was generated as described previously.

Genome Sequencing and Analysis

Genomic DNA was isolated from NB001 and NB004 using a PureLink Genomic DNA Mini Kit (Invitrogen). Samples were prepared for multiplexed Illumina sequencing using a Nextera XT DNA Library Preparation Kit (Illumina) and run on an Illumina MiSeq using a 2×150 bp paired-end kit. Approximately 10 million sequencing reads were obtained for each sample. De novo assembly of the reads was performed with the Geneious De Novo Assembler (Biomatters), yielding an average coverage of ~100 reads/bp. Gene annotation and alignment was also performed using Geneious.

Porphyran PUL Transfer and Knockout

Generation of the porphyran utilization deficient mutant was performed using tdk counterselection as described previously. A thymidine kinase (tdk) deficient mutant (NB007) of NB001 was generated by exposing NB001 to ultraviolet light for 60 seconds and plating on BHI-BA supplemented with 200 ug/mL of 5-fluoro-2'-deoxyuridine (FUdR). Eight genes predicted to be essential for growth on porphyran (homologous to BACPLE_1692-1699) were knocked out using pWD034 (Table 7), a plasmid with 1.5 kb of homology upstream and downstream of the target region assembled via Golden Gate Assembly into an erythromycin-resistant, tdk-containing vector.

TABLE 7

List of plasmids used in Example 2

Figure 12A:
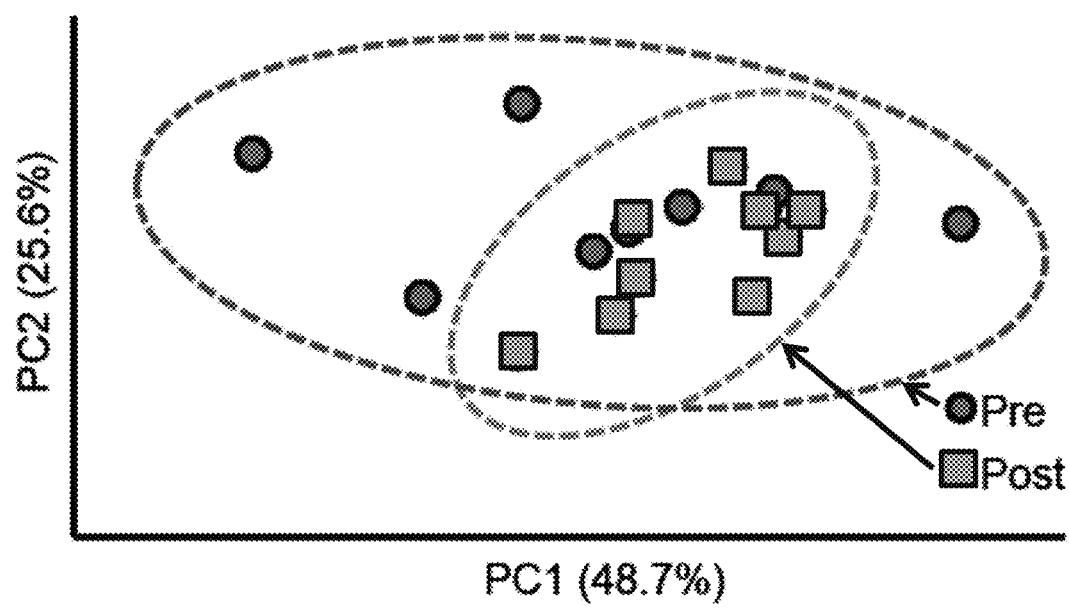
FIG. 12A-FIG. 12B. Porphyran extract did not significantly impact the gut microbiota in the absence of a known utilizer. Weighted UniFrac analysis was performed on fecal 16S data for conventional mice colonized with a porphyran utilization knockout (FIG. 8c) before addition of porphyran extract (Pre, n=8) or after (Post, n=9).
Figure 12B:
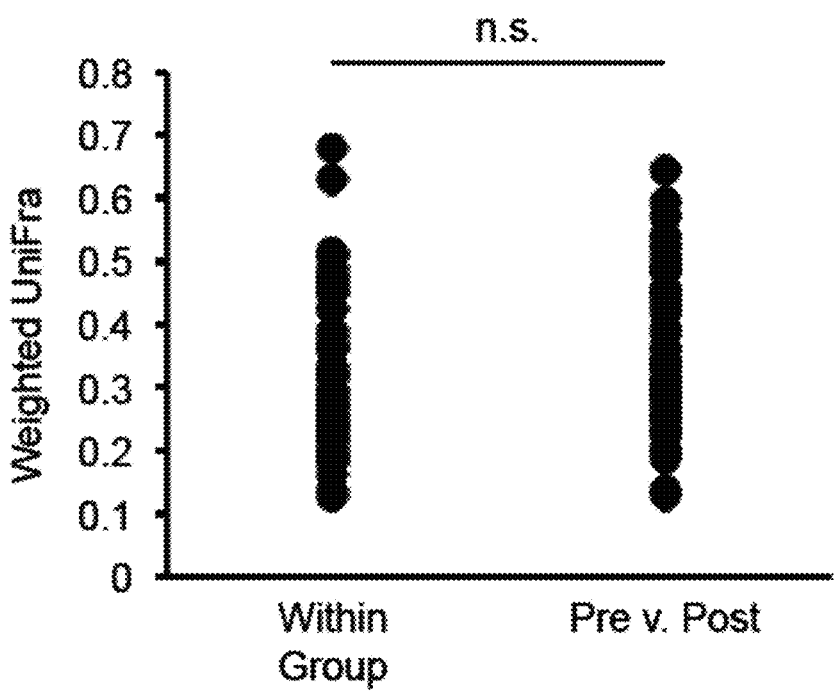

| Plasmid Name | Description | Length (bps) | Parts used in yeast assembly | Relevant FIG. |
|---|---|---|---|---|
| pWW3452 | High GFP, erythromycin resistance | 6,031 | N/A | FIG. 7, FIG. 9e |
| pNBU2-ermGb | Erythromycin resistance | 4,909 | N/A | FIG. 2, FIG. 12 |
| pNBU2-tetQb | Tetracycline resistance | 6,662 | N/A | FIG. 8, FIG. 12 |
| pWD034 | Porphyran PUL Deletion (main operon) | 7,148 | N/A | FIG. 8c |
| pWD035 | Long Porphyran PUL | 72,558 | PCR_01, PCR_02, PCR_03, PCR_04, PCR_05, PCR_06, PCR_07, PCR_08, PCR_09, PCR_10, Vector_01, Vector_02, Vector_03 | FIG. 9a, b |
| pWD036 | Medium Porphyran PUL | 53,695 | PCR_04, PCR_05, PCR_06, PCR_07, PCR_08, PCR_10, PCR_11, Vector_01, Vector_02, Vector_03 | FIG. 9a, b, c |
| pWD037 | Short Porphyran PUL | 32,364 | PCR_05, PCR_06, PCR_12, PCR_13, Vector_01, Vector_02, Vector_03 | FIG. 9a, b |

Generation of the porphyran PUL knock-in strains required expansion of previous knock-in methods due to the large size of the PULs (20-60 kb). Based on gene annotations and sequence alignment to a previously published mobile element conferring porphyran polysaccharide utilization capabilities, we designed three minimal PULs of varying sizes (20 kb, 40 kb, and 60 kb, FIG. 9a). To propagate such large pieces of DNA and integrate them into the Bacteroides genome we used a three-step process: performing yeast assembly into a custom shuttle vector, propagating it in S. cerevisiae and E. coli, and then performing conjugation and genomic integration into Bacteroides species. The minimal PULs were each divided into multiple 6 kb fragments with 200 bp homology between pieces and assembled in yeast with fragments containing the KanMX selectable marker and CEN6/ARS4 origin for selection and growth in yeast, the bacterial artificial chromosome origin and chloramphenicol selectable marker (from pEZ-BAC vector, Lucigen) for selection and growth in E. coli, and the conjugative origin and parts for integration and selection in Bacteroides (Tables 2, 3, 4—see above). Yeast cells with successfully assembled constructs were lysed by mechanical disruption with 0.5 mm glass disruptor beads (USA Scientific), and lysates mixed 1:20 with electrocompetent E. coli S17-1 cells and electroporated. Successfully transformed E. coli were then grown and conjugated with NB004 and B. thetaiotaomicron VPI-5482 (Bt) as previously described. NB004 successfully integrated all PULs, but Bt was initially unable to integrate any PUL constructs. To improve rates of genomic integration, we pre-integrated an NBU2 integrase-expressing plasmid with tetracycline resistance into Bt, and this improved efficiency such that Bt conjugants were obtained for both the short and medium length PUL constructs.

Nori Extract Preparation

Raw culinary nori derived from *Porphyra yezoensis* (https://www.rawnori.com) was added at 10% weight by volume to distilled water and subjected to hot water extraction by autoclaving for three hours. The mixture was then cooled and centrifuged at 11,000×g. Resulting supernatant was ethanol precipitated by combining with 200-proof ethanol to a final concentration of 80% ethanol, 20% supernatant and incubating at 4° C. for 24-72 h. Precipitate was recovered by centrifugation at 26,000×g and dried for 24 h before manual grinding to generate a measurable powder.

Mice

Ex-germ free or restricted flora (RF) conventional Swiss-Webster mice (Taconic) were housed in gnotobiotic isolators and fed either an autoclaved standard diet (LabDiet 5K67) or a custom diet as indicated below (Bio-Serv) in strict accordance with a Protocol for Care and Use of Laboratory Animals approved by the Stanford University Administrative Panel of Laboratory Animal Care. Introduction of all Bacteroides strains into either ex-germ free or RF mice was performed by oral gavage of $10^8$ c.f.u. of the given strain in culture media.

Mice were humanized (FIG. 7) with fecal samples from healthy human donors were stored at −80° C., thawed and resuspended in pre-reduced PBS in anaerobic conditions at a 1:1 dilution, and 0.2 mL gavaged orally into germ free mice. The mice were allowed to equilibrate the human microbiota for four weeks while consuming the standard lab diet. One week before introduction of NB001, mice were switched to MAC-deficient chow (AIN-93G, 68% glucose). Seven days after introduction of NB001, mice were switched to custom diets with inulin or nori as the only available MACs (AIN-93G, 10% unique polysaccharide, 58% glucose). RF mice (FIG. 8, FIG. 9) were administered nori extract in the water at the percent indicated, weight by volume.

16S rRNA Analysis

DNA was extracted from fecal samples using the PowerSoil 96-htp kit (MoBio), and amplified at the 16S v4 region (515F, 806R). Qiime 1.9 was used to analyze the resulting Illumina-generated sequencing reads as previously described*. Data were rarified to the sample with the lowest number of reads (16384), and open-reference OTU picking via UCLUST and taxonomy assignment through the Greengenes 13.8 database was performed.

Microscopy

Tissue was harvested and immediately fixed in 4% paraformaldehyde in PBS for 48 hours at 4 C. Cassettes were transferred to 20% sucrose for 24 h, and then samples were embedded in OCT Compound (Tissue-Tek) before sectioning at 30 µm on a Leica CM3050 S cryostat. Sections were stained for 30 minutes with 4',6-Diamidino-2-phenylindole dihydrochloride (DAPI; Sigma-Aldrich) and Alexa Fluor 594 Phalloidin (Life Technologies). Images were taken on a Zeiss LSM 700 confocal microscope.

Example 3

Figure 14A:
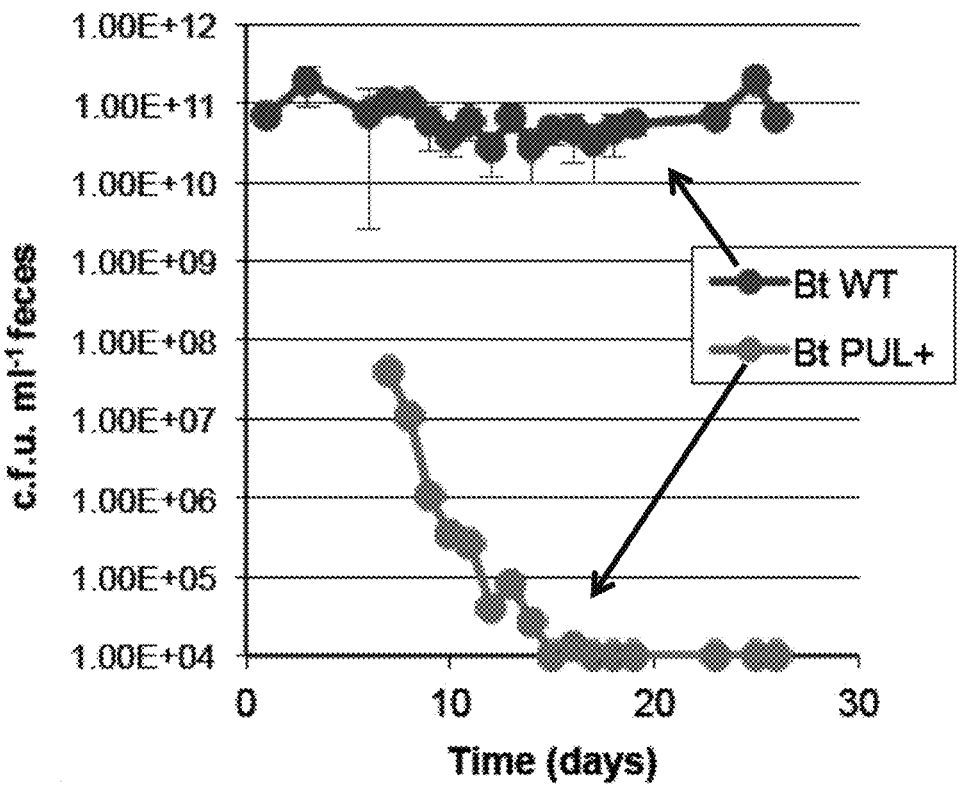
FIG. 14A-FIG. 14C. Data showing that access to porphyran allowed for crypt invasion and stable maintenance in the presence of an exclusionary primary colonizing strain.
Figure 14B:
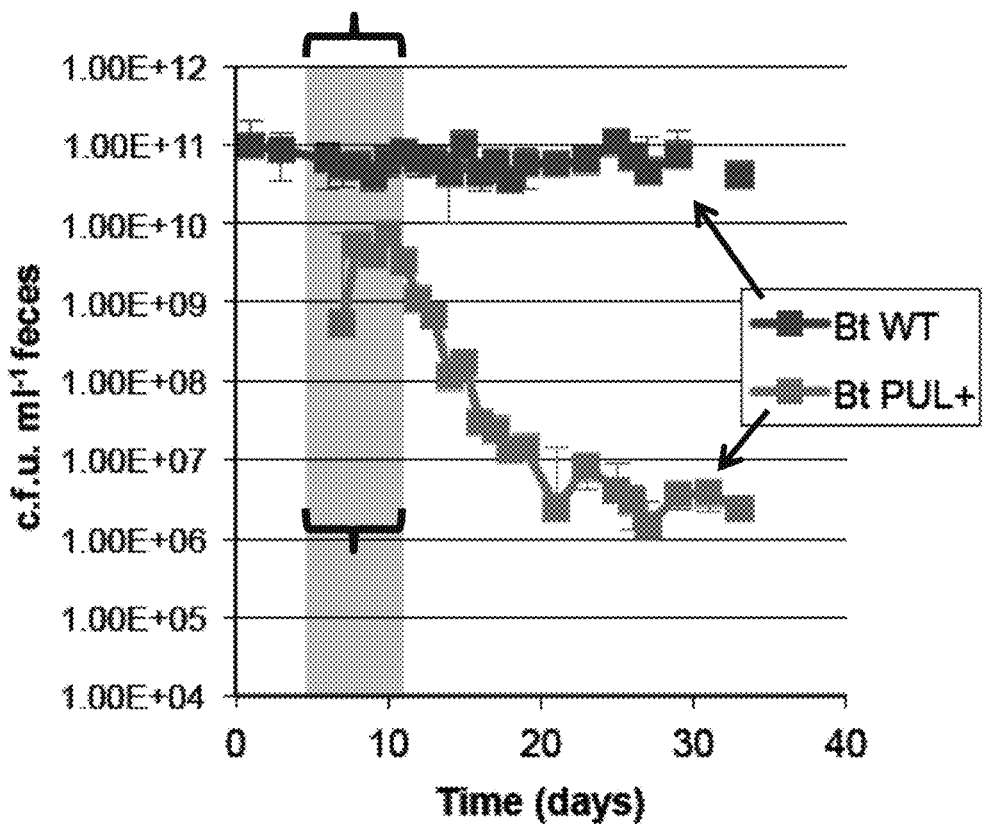
Figure 14C:

FIG. 14 (panels A-C). Access to porphyran allowed for crypt invasion and stable maintenance in the presence of an exclusionary primary colonizing strain. Germ-free mice were colonized with B. thetaiotaomicron strain VPI-5482 that was unable to utilize porphyran. One week later, the mice were challenged with an isogenic strain harboring the medium-length porphyran PUL, and continued drinking normal water (panel A) or were administered 1% porphyran in the drinking water for four days (panel B, brackets). After four days, mice in panel B were switched to regular water, and two mice were sacrificed and images of the proximal colon were captured, demonstrating the challenge strain (panel C, green) colonizing the colonic crypts with the primary strain (panel C, red). Colony forming units were tracked in the feces for the duration of the experiment, demonstrating that without access to 1% porphyran in the water (panel A) the challenge strain clears, but with short-term access the challenge strain maintains stable co-colonization with the primary colonizing strain. These data demonstrate that with access to porphyran, an incoming strain can enter the colonic crypts.

SEQUENCE LISTING (84 sequences)

SEQ ID NO: 1 - protein, 775 aa, Bacteroides Plebius
MFLMTSLLRKRLFIGYFITGFIVLSMVTVMINERCRLKELENLIIQINEAYENTNKVHLYITKLATLGESVIVWDESDYNIFHNQRFKTDSVLLEIKLRSCDFLCPVQIDSLRELLKTKEMHLFQIMKAVQFANKSDSILTNELPVIATQTVKVKTITQKKKGIAGLFGKKETIQVPYITNEIQNFNNRLVSVIDMRNNQIETYVDSLRLQNRLLNQKLYDFVSFLDNQVQLSFIERNLEVTEVKQESFRLFIVMMSIAVFIILISFLIIQSDLRKEEIIKFKLQQAIQENENLLDMRKKIILTVSHDIRGPLGNIHNCADLVSETREKRKREKYLDDIRHSCRHVLHLVNDLMDAYRINEAGNLRNDTPFYLDRFLQRISDEFSRKATSKGLILYSEHKGSNVIVKGDADKLEQVLANLLTNAIKFTSRGNVNFHSEYSEGKLRIEIRDTGIGMDEETLKRIFAPFERAAQNVNSEGFGLGLFLTKGLIKVLEGKMDVESVLGKGSMFRLELSLPETDELVEEDKSDHNTITILPKNVLVVDDDPIQLKIAEDMLGRKGISCKTCKNAREVVAALENSEYDLILTDVQMPDTDGFGLLRLLRNSDIGNSRTVPVAVMTARGDGNSGIYEKEGFVGCIHKPFNIHGLLAFLSTIISRTQVSVSGEFDFSSLLENTDDYSHMLSLVVMESEKELEEMESADRITDRETMRKIIHRMMPVWEMLGKDNILRDFQRLLHDSDSQNETVHEHAIQIMEWLKILIEETKKELKKYENSDS

SEQ ID NO: 2 - protein, 316 aa, Bacteroides Plebius
TMRKLFTICLASLQIACAAEDFNNKSYEWDIYPVPADAGDGMVWKLHPQSDDFNYVADEKDKGKEFYAKWTDFYHNHWTGPAPTIWQRDHVSVSDGYLKIRASRPEDVPMKKVVSGPNTKELPGTYTGCITSKTRVKYPVYVEAYAKLSNSTMASDVWMLSPDDTQEIDIIEAYGGDRDGGGYGADRLHLSHHIFIRQPFKDYQPKDLGSWYKDDKGTLWRDDFHRVGVFWKDPFTLEYYVDGELVRTVSGKDIIDPNNYTGGTGLVKDMDIIINMEDQSWRAVKGLSPTDEELKNVEDHTFLVDWIRVYTPVPEE

SEQ ID NO: 3 - protein, 402 aa, Bacteroides Plebius
MRKIILAAGMMSLLAACGNTGNTQTIAVDDTQNYDERKADSLGIPKGNKLSAAMKRAMKWENHDNKWFFEYKMEPLKGDLAYEEGVVRRDPSAMLKIGNTYYVWYSKSYGPTQGFAGDIEKDKVFPWDRCDIWYATSKDGWTWKEQGIAVKRGEKGAYDDRSVFTPEVMEWKGKYYLCYQAVKSPYTVRVKNTIGMACADSPEGPWIKTDKPVLEPSNTGEWEGDEDNRFKVVSKGDFDSHKVHDPCIIPYKGKFYMYYKGERMGEEITWGGREIKHGVAIAENPMGPYVKSEYNPISNSGHEVCVWPYKGGIASLITTDGPEKNTLQWSPDGINFEIMSVVKGAPHAIGLNRSADAEKEPTEILRWGLTHIYNSSDYQSIMRFSTWTLQTHTAKGESKERK

SEQ ID NO: 4 - protein, 851 aa, Bacteroides Plebius
MTSKKHVKPKIMRNKNLLALIILLSTLKVSASDSNVDFNKDWKFVLKDSAHYSYTSYVPGDEWKKVNLPHDWSVGLPYDSISGEGCVAFLQGGIGWYSKSFPTTISANQKCYIVFDGVYNNSEYWINGKKLGYHLSGYAPFYFDVTDYLNPNEDNRMTVRVDHSHYADSRWYTGSGIYRDVKMIVTDRLHIPVWGTFVTTPVVTDKYAKVNNQITVRNSYSEPRTAVVEIVYKDNKGNIAAFEVFSIKLNAGEEKIIDIVSEIKQPDLWSVEIPVLYTAETRIKNGDEVISENTVRFGIRTFHFDADKGFFLNGKNMKIKGVCLHHDAGIVGTAMIRDVWYRRLKTLKEGGCNAIRLSHNPGADEFLSLCDEIGLLVQEEFFDEWDYPKDKRLNMKETVEDYPTHGYCEHFQEWAERDLKNVMRRSRNHACIFQWSIGNEIEWTYTGCREATGFFGADSNGNYFWNQPPYSKEKIREMWKIQPKQAYDIGRTAQKLAAWTRQMDTTRVVTANCILPSISFETGYIDALDVAGFSYRRVMYDYAKKNYPDKPIMGTENLGQWHEWKAVIERDFVPGMFIWTGVDYLGESGSRLSRWPQKSIGCGLLDMCGYVKPSYDMMKSLWTDKPFIAIYSQTPDKSSYLQVKDGFTDKKGHEWDRRLWVWDDVNSHWNYQKGDSVIVEIYSNCDEVELFVNGKSMGKKYIDDFEDHIYKWAVQYKPGTITAKGKNKLGNTTTAIRTSGKEHSILLAVDKQSIAANGKDVLHVTAQLTDKKGNPVKTTEQMLKFNIDGEYRLLGIDNGNVKNVSPYQSKEIMTYQGRCMLMLQSTEKTSVLNISAETSELQSNKLTINIK

SEQ ID NO: 5 - protein, 851 aa, Bacteroides Plebius
MTIKNIITVLTIFLSGFCYAGTSTKVDFNFDWKFSKPAGFVPQDTLFLSPDIKWEDVCLPHDWSISEGYTKTQTAGSNGFLSGGVGIYMKNFLTSDDMNGKKVFIHFEGVYNNSKVWINGHMLGFRPNGYVGFEYELTQYLKPKGSMNTITVCVDRRAYADSRWYVGAGIYRNVSLILRNELYIPSDGIFVTTPQVGNRSMVNVVCEVKNAGTGVKGVTVKHEVVYDGKTIASVSDDFVALKGDFNEFTASVELENCHLWSLETPSMYELHTTLIASDGYVMDKKTTKFGIRDIKFDADEGFLLNGKSVKIKGVNIHHDLGCMGVAAYDDALLRRLLKLRSIGCNAIRTAHNPHSESLLEMCDSLGLLVMNEFIDEWKVAKKKWITERAKEDAPDSISIGYTRYFDTHAEHDLKSFIRRDRNHPCVILWSIGNEIEWTYPYYWASSKDNKGFKGLIHTGDPETDNKSILKEFNRLSGGKDDLAETAAVLAGWVKDVDTTRPVSSGVVVPSVSRLSGYTDVLDVVGYNYKDKYYEIDHKLYPYQPIIGSENVGQLFEWTAVADKKYIAGIFVWTGFDYLGENGPWPARGGDCSFFDFVGNKTARGHFFECLWKDTPKTHIVTIPEKESEFKMDTDGSFTYTPRPGWIRRWEWYDTRDKWKYRRDEDILVQVYTNAPEVELFLNGKSLGTKKRSDFMEHNILMWKVAYKEGTLLAVGKDGDRILSKDTLSTSGKPCRLALNCDRKTATDNGYDLIHVEVSIEDKEGNTVVDIPSDVRIILDDKLELAGLDNGSPSIEDLNINVINNSVRTYNGKCLFVLRTIRGKKGTSFVKVVGDGGIQGRCKILISHPISH

SEQ ID NO: 6 - protein, 495 aa, Bacteroides Plebius
MTEYIQINPADNVAVALHPLSKGTVIEVNGNSIELMEDIPAGHKIALKDFAEGDMVIKYGFPISHAVKEVRKGHLLNEKTVKTNLSGLSTYTYTPKFEKQTFTNENHTFKGYLRANGEAGIRNEIWIIPTVGCVNGIVNQLAEQLRKETGCEGVDSIISFPHNYGCSQLGDDHENTRKILRDMVLHPNAGAVLVVGLGCENNQPDAFREFIGDYDTQRIRFLVSQKVDDEIEEGMKLLREMYAIAREDKRTDVPLSKLRIGLKCGGSDGLSGITANPMLGVFSDYLVAQGGTTVLTEVPEMFGAETLLMNRCRTKEIFDDTVAMINDFKNYFIRNDQPIYENPSPGNKAGGISTLEEKSLGCTQKSGSSMVEDVLKYGDRVTTHGLNLLSAPGNDLVASTALASAGCHIVLFTTGRGTPFGTFVPTVKVSTNTPLYEQKHTWIDFNAGTLVEGESMESLSRRFIDFVVEVASGKQALNEKKGYREIAILKQGVTL

SEQ ID NO: 7 - protein, 480 aa, Bacteroides Plebius
MKALNSKTAVKAVRPERIIQFGEGNFLRAFVDWIISNMNEKTDFNSSVVVVQPIEKGMVDALNAQDCLYHVNLQGLNNGEVVNSFRMIDVISRALNPYSQYNDFMALAEQPDMRFVISNTTEAGINFDPSCKLEDAPASSYPGKLTQLLYHRFKHFNGDKSKGLIIFPCELIFLNGHKLKETIYQYIELWNLGEEFKSWFETACGVYATLVDRIVPGFPRKDIDNIKTKLYFDDNLVVQGEAFHLWVIEAPESVAEEFPANKAGLNVLFVPSEEPYHERKVTLLNGPHTVLSPVAFLSGVNIVRDACQHEVIGKFIKRVMFDELMETLNLPKEELKKFADDVLERFNNPFVDHQVTSIMLNSFPKYATRDLPGVKEYLKRKGVLPEGLVLGLAAIIVYYKGGKRADGVEIVPNDAQEIMAMLTSLWNDGSVENLVKTVLADTSIWGEDLNTISGLADRVIYYINKIQSEGMLQTVKDLVG

SEQ ID NO: 8 - protein, 338 aa, Bacteroides Plebius
MKAVQITEAGKVQVADIVKPTLGAGEILLRIKYVGFCGSDLNTYLGRNPMVKMPVIPGHEVGAVIEEIGEGVPVGFEKGMNVTVNPYTNCGKCASCRNGRVNACEHNETLGVQRNGSMQEFLVLPWTKVIPAAGLSDKECALIEPMSVGFHAVSRAQVTDIDTVAVIGCGMIGLGAIVRASLRGARVIALDIDDEKLELAKRLGASMVINSKTENVVERVRELTDGYMADVVIEAVGSPITYVTAIDIVGFTGRVACIGYAKSEVAFQTKYFVQKELDIRGSRNAMPEDFRAVIHYLQNGNCPMNELISAVVKPEEAGEALQKWSENPGKVFRMLVEF

SEQ ID NO: 9 - protein, 417 aa, Bacteroides Plebius
MKNKYFIPLLLIFSLFFMWAISSNLLPTMIRQLMKTCELNAFEASFTEAAYWLAYFLFPIPIAMFMKRFSYKSGIIVGLILAAIGGLLFFPAAEIKEYWAYLVIFFIMATGMCFLETAANPYVTALGTHDTASRRLNLAQSFNGLGAFISAMFLSKLILTGQNYTRETLPADFPGGWDGFIQMETDSMKMPYLVLAVLLIILAVVFALYKLPDIDKEESHGEKGKLINFAVLKRKHLRWGVIAQFFYNGGQTAINSLFLVYCCMYAGLSEDEATTFFGLYMLAFLGGRWIGTMLMSKFRPQDMLLTYAIVNIILCGVIIMFGGMTGLYAMLAVSFFMSIMYPTQFSLALRDLGEDTKSGSAFLVMAIIGNACIPQFTAFVMNHNADFYQVAYVIPLICFFFTAYYGWRGYKIEKKQH

SEQ ID NO: 10 - protein, 307 aa, Bacteroides Plebius
MDYTIIDAHSHLWLYQDTEVDGLKIKTTENGQSLFMGEVRQMLPPFMIDGRNTAEVFLANMNYAQVGGAVVTQEYIDGIQNDYLLEVMTNYPDRFFVCGMCEFRKQGYFNQTVELIDKGFKAIKIPGHRLQLKDGRVMLNSDEMMKMFHLMEDKGVILSIDMIEGDLQVGEMEEIISECPGLKIAIGHFGMVTKPDWKKQIMLARHKNVMIESGGITWLFNDEFYPFNGAIRAINEAADLVGFEKLMWGSDYPRTITAITYKMSYDFVIKSKELEERSKKLFLGENAKAFYGFKNLPELPYIKNMSE

SEQ ID NO: 11 - protein, 310 aa, Bacteroides Plebius
MEYRELGKTGLKVPVLSYGASSLGGVFHSIKESDAIQSVFTAVERGLNFIDVSPYYGHYKAETVLGKALKELPRESFILSTKVGRYGKDGVNTWDYSDKRAQESVYESMERLNIDYIDLINVHDVEFSDMNQVVNETLPALVELKKKGVVGHVGITDLQLENLKWIIDHAAPGTVEAVLNFCHYSLNDDKLVDFLDYFDENGVGVINASPFGMGLLTHRGVPEWHPAPKPLIEVCAKAAKYCAEQGYPIEKLAVQFSVSNPRIPTTLFSSARTESVLQNIKYIEEPIDWSLVEKVKEIIGDQQRVSWANS

SEQ ID NO: 12 - protein, 127 aa, Bacteroides Plebius
MKTEGYKVKSYSLPVKRYCQTLSLRENPELIEAYRKAHSKEEAWPEIRAGIREVGILEMEIYILGSKLFMIVETPLDFDWDTAMAKLATLPRQAEWEEYVAKFQQCAEGATSDEKWKMMERMFYLYE

SEQ ID NO: 13 - protein, 181 aa, Bacteroides Plebius
MIHILSLDTCKYKKRLLIPVFIFLSANVQAQLHFSTTLQNMILWRGIEVADGLILSSDLSVSDPSGRFTAGFLGGSNTRGSYKELSQYIAYTHGRFQIKAIDTYNFSPGATYNNKEFFNYKPDETGRFVDLMVNYTGDRKFPLELSFSTLVYGRDRDLDNSKNIYSSFVYVGYTIYQNEKL

SEQ ID NO: 14 - protein, 523 aa, Bacteroides Plebius
MKYSTIITKTICLSVPFFALSCEDPQEEFSYIPPEVIYSQPGNVEDYNTPGDNAGDNDDDDVELQLPVPGPAETYPNSTKQYQPIIVEYAEKPDKAFIEAKTRILPYLVGYEQQTKTQDEYLQSVNKYGSYAKGQKSKATGRFRVEKNSNGRSWIVDPEGYPYYVRGIASFRMDGNSSAFGKLYSSVDDWVAKSQKQFSEIGFHSVCAFGKEEGDKAVNDYNKSASSPLTQAPSFSFLAEFKNSKGISYPGQNVNLKIGLVFYDGWDEWCKEYLNSDAFGMFRNNPDVLGFFSDNEIDFSTWGNRLLDRFLKISNKQDPAYIAAAKFMTDKDKSANVSDVTDELNNEFAGICAEKYYSAIKNAVKASKDPELLYLGSRLHSLPKYNSYIIKAAGKYCDVISINYYSKWSPEKGYMDGWKNQAGGTPFMVTEFYTKGEDTKLDNSSGAGFVVRDQQNRGFAYQHFTLGLLEAKNCVGWVFFKYLDDEDCNKGMLDYNYKPYTSLTKYMSDINWNVYNLIEYFDK

SEQ ID NO: 15 - protein, 762 aa, Bacteroides Plebius
MLYILIAVLPSFSFAKKTDAQQVREMIEQVNDAWQKNHAPEARSFWDYAAYHTGNMEAYFLTGKEEYRKYSEAWAEYNQWMGAKSNNKSEWKYKYGVKDDYVLFGDYQVCFQTYADLYNIMPENYKIKRAREVMEYQMSTPRKDYWWWSDGLYMVMPVMTKMYKITHNHRYLKKLYEYLCTSDSIMYDEEEGLYYRDAKYVYPKHKSLNGKKDFWARGDGWVLAALAKVLKDLPEGYEHLSFFEDKFVRMAKAVACLQQPEGYWTRSMMDPEHAPGPETSGTAFFTYGMLWGINNGYLDKDEFMPVVEKAWKYLTKTALQKDWSVGYVQPIGEKAIPGQVVDAKSTANFGVGAFLLAACEYVRYLEANNNETRKYWTDMAYRMAAPVLSNMAKGELQKNMILEVSPNWDNRNKKVAYMETFGRLMAGIAPWLSLPDDDTAEGQQRKQLKEWALKSYANAVDPNSPDYLLWNGHGQALVDAAYIAESFLRAFDQLWKPLDQTTKERYIKEFKGLRRIDPPYTNWLLFSATIESFLAKIDAGQDTYRINSTFRKVEEWYVGDGWYADGQHFAFDYYSSYVFHPMYLESIHAIMESGVRTRFDYRKYYDRALMRAQRFAMILERFISPEGTFPVFGRSIPYRMATIQPLALIAWYNELPAGVSKAQVRCALTACMKRMFKSGNNFNEGGFLTIGFCGHQTGISNHYTNNGSLYMTTLAFLPLGLPASDPFWTDADQPWTSVKAWGEMEFPIDHRWGDTIRTWDLY

SEQ ID NO: 16 - protein, 564 aa, Bacteroides Plebius
MSIAMLQSCTKDELSNVNAVSGPQDMTFVAGTPSSRSSLQNGTTVWWTTGDAINIFSGQENNKFTTATGGSTVTTFTGKATPNNSYTALYPYNAEAVCLEGVVTTTLPSEQTAPAWGFDANANISYATATDNNKSLTFQNTCGLVKFKNNLTDLTGIKLTAGGDVKIAGNVKIDASANLTVESGSNVITLTAKEGTFVGPNEQNKNAKEYSMVVAPVTFTDGFTLELTRNSGTKTYNFSGENLIVTKGQIVTIVLNDDQGGGEPPVDLEKQTTVAVSSAKEIVPDQTTGNDRIELTLDKEVSGTFTDAVNKAFTITVAGKTIPVASGSVNGTTMTLILGDKIYSNDANISVSYNTDYAVSALTAKNENNEDANIKIESANVALTHADAFDFNFANIDAVKEYLAEGVAEKINASGELEIVPADNQFPVTKSMSFRDGCTYKFTYTYASNDCATTFRLGASDKYKFWIGRNTGSGTYTNTFTISSSTSAETPASRADGSLVWPVLENVILTVQTNVPGGTDATGTAKITSFKIEEITERPSTGADASFDSTTEGFNNGAEWTPNK

SEQ ID NO: 17 - protein, 170 aa, Bacteroides Plebius
MVDIKPRILSVYNLFILLFIQFTAISCDKDDDGVGGGDGTPAEEIKIEYVVFKDGQTDNKPVSYIELPYSGTVELGINITKDNLPYTGYKSIVWGTSFPDVLMITPSDDKMRCTVVAIDGGRDSNIGASVDTGNGIKSAVCRISIPPGIVDGGHDDFEDDGTEWKPDPKE

SEQ ID NO: 18 - protein, 156 aa, Bacteroides Plebius
MMACGMMMTSAYAQEIKNGDFESGDLTSWNVWEKKDNKIVDAKKAHSGNYAVEVKVGMWQAVNISYETGAEYQISAYTKYSWGDKPNFRIEYYNPDSKKLEEIATAEVKKDRKNYNLTTVKFKLQENGFVYRFTAVPGSGNGGCFLLDDVKIEKVK

SEQ ID NO: 19 - protein, 321 aa, Bacteroides Plebius
MRKTVLYLSAASLFLSSYTLKNDKEYSLAEEHIKNLPEAPEGYKWVVNEDYTDEFNGKRLNAAKWHAKSPYWTNGRPPATFKAENVSVKKGCLRIINTVLSPTEGLDGKPGDKYRLAGGAVASAKNQAHYGYYETRMKASLTTMSSTFWLSNRPVMKEIMKGGKKIKTWSSQELDIIETMGIIRSVNPDNPWNKTWNMQMNSNTHYWYQEQGGKRTDNTAKRSDVVSYMTDPSAEDFHTYGCWWVDANTVKFYYDGKYMYTIKPTTKYTDTPFDRPMFIHIVTETYDWEKQVPTAEDLKDKDKSTTYYDWVRAYKLVPIEE

SEQ ID NO: 20 - protein, 436 aa, Bacteroides Plebius
MRNFISFYVLIVLCFTIISCKDETEISDFEVSEVTFDTKLRDVLTRKGFNFSENGELICDNQVLNTTSLDLSRCELTSISGLRSFPSLADVNLECNSFSIFDFADLPEGIKSVALRGNDGITSYLNLISTDGTTVLCKSLTNLKLPYFAKWNTDVIPAFYKAMTDKCLVVMSDEDGNYTEYTVNRRVPDPLLRSYLYRNFPSVFVSSLEIDVTKRITEGNDLIFLSQTANLEGVEYILSNPGFRGKVDISGVKSKHYSMSYVKPSSGVSVFSISNIDTPLGMDLSSASSLKVLRVENNSSLQLVVVPSVILNDDVSETSIFDSEIHISGCSSLESVSLQGSKGGNMIGKLHFADLPALDYLDVSAVEAVNTVVLTDVNPGIGSILLPSELTAFLDGTGRFSPTSQIALCINHPKVSSFMEYCKNVADIIDVSFFYK

SEQ ID NO: 21 - protein, 728 aa, Bacteroides Plebius
MSYKYIFLLSAFTLGVPPGIYCQERNEVVVDYNTRRFLSGVSELDRSKYFNIHSTSDDDKDVGKFLADYQVGLGRKFWGPYSYAYNKTHEVGKYPQMKPYSGNISVKRYIATEHPYVQHIQGGIDVQAAGAWSAEYYSNSELVPEFFEPLNEPFVHANDAGFTVQGQAMRELMVDFYASIGKHIHNNPRLNGKMKVIGYAAAYPAWEDGNFNYWNTRMKMFIDRAGAYMDGFSVHLYDGINVTGTDTKRSGSNSEAVLDMVEAYSYIKFGHVKPLAISEFGGIDNSKPDDSYDDISSVRSVSSFNHFLFNLMERQDNLFISIPFVSDKAEWHITAANNYTSYSAALFIPDNPQNLKNTTWRLNDKKYFFELWKNVKGERVDITSSNPDIQVQAFKDGGRLYIALDNLDDNPQTVYLNNKNSWKDVSNVTKRSLYVNYNAGIEYTEQNVPSMPESISIVPNQTIVLVADVSSSAFTNSIIRNKYYSSEYLKPISAGSSLSFPFTGIESGSGRASLRMSIGRPVSASKKPVVKINGTAVSVPDNWKGYGQSNRNIFFGMIEVPFDIQLLKNGDNNVDITFSDGGGHVSSMILQVEKYTVSTLQNGTFSEGLSAWQPLGNYGTVCVQTDNAGNNVACISGHAGLMQRVDMESGRTYRFSADVKTEGACKLKVMLQDMSTGTVYTEEFSSPGNYKAVSFDFNSTVKKVVCAIVCERQNDAAWIDNIVLLPQN

SEQ ID NO: 22 - protein, 595 aa, Bacteroides Plebius
MSFSVFPLSSSENKTYNTTVTVDYATQRYLNDVSALDRGKYFNIHTSKDSDPDVRKFLADYGVGIGRSFWGPFSYSYGKTKKVGEYPFSEKPLNYTDLKETKRYVATEHANARTIQWGIDPVKAGAWAAEYYSKHVKGAVPEFFEPINEPFVHARDKCFNMHGQEMRMLMADFYAQTGKHIHAEPSLKKMKIIGYAAAYPAMELRDFDHWNNTMKMFIDRAGEYMDGLSVHLYDGINIVGKSSRRSGSNSEAILDLMENYSFIRLGKVLPLAVTEYGGIDNTSKGYNPIASVRTVASFNHILFNLLEREDKMLISIPFVSDKAEWHITKQYNFEPYGAALFVANNPHDLKNTAWKLNDKKYFFKLWKDVKGERVDIVSDNPDIQVAAFKDDDRLYIAVDNLDDYTHKVNLKNVLNWKGVDNVSVRSLKMIFDKGIVYDEKTLNSMPQSIDIIKDETIILCADIIRKKYSNRIVRTKYYSNTYLQPVEAGKPIVFDFDGLKPGTGRAVLRMSIGRKHEMSKKPEIMVNGKKVDMPDNWRGYDQTGRDDFFGMIEIPFDYRLIRKGKNSVSVTFPDNGGRVATMILQTERYDKKVRK

SEQ ID NO: 23 - protein, 166 aa, Bacteroides Plebius
MFGACDNDKWAEVELDSTPVYELTYLKNVETGKTGEVSKFSVYRELFDLIAWKNDYQTLRMNKIEFFAESSEAPSELPEWLKINSDTEKHLSFSFNEVYTEKEEVINPETGDKEEQEVTKKRMFMFEGKKENNSSGGYGHLTVTENDGTEVEYEVVLNDVLKPADF

SEQ ID NO: 24 - protein, 574 aa, Bacteroides Plebius
MKNRFLYIALSLISVLTSCKDDEFEPLNNVAECTWHVSTDQENVSPIQLNLNNYISIMDLSQGMLSHQWVVSDDGTKFLNGKMEWGQTDYTNLIDESIPHTNDLKTIHVYFTKPGDHTVRLCNTFRRQVVYPYSVYDDNTGGYIKKYCYAKQEGDVYVMDTTFHIRVYDPNLVPAVKVYSDPECTQEIKTGIVGGTEEAPEYEKYELEYGKSVYIKDDSYGLPNKWTFKCADTGVNDELTSFDTPYQFTAKKFSDKPLLLSMTIERTSASEGKGKYTPKASPKTLVVPLAITVVPSDDPITYNIRQIDQTHIAIDLDNSEFGYKEINPSSLKLTYSNSYNRPSAVRGSVNITAAEVNKQSRYELILTLVEKIYNTDELTLTGTLTEALVGYQNLEIKATAPNVATTFGAFLDEDFENSDTYADWKVIDADTKTHPVVPSQVVDNPLKDGINNSAKCMFVEAFDRCRALLSKTFTGGKGTYTFSYKYYTPGYKQGKGMSPYFVPAGKEGAEDMTWQSDRPWCGIVNGSDSKWMSATTTVTSKAEMDNILLSMRFNAFKDNIYFDDIFFGYIEVRP

SEQ ID NO: 25 - protein, 678 aa, Bacteroides Plebius
MNFRYKTIVFSLLMSGMTLVSCDDFLTQENIHQLTTQNFYKTIGDCEKGLAAVYNALKNTNIYHPLDENRRSDIAVEGNKDRKQFDNEAYKQTFNDSYGTVRGKWSALYTGVFRANQVLASIEKIRPNVTDEPQITKLAQIEAQAYSLRGLFYFYLNNSFNNGNVPYINEIAEVEEDYYKKVTPSDEIKKYYREDLQKALDLGLNDKWEKTDLGRITSWAVKAILGKSYLYDKEYNKAAEYFKDIIDNGGFALVDDIVDNFTAANEFNSESILEVSYSTQYNTEFGTWSESTLYNIWGMNVNGLGDAWLNTVPAFWLVEAFETEPVDRLDERNWIKMQSDNYGDPEHRDIIYDQLGTTFSSQVDRQGVVYNRTYVYTWDATAGKYVGVRERLVSTVGDNKVLYNKITGYDDIVPEFKWEDGQAYRLRSYSMRASASLAINGDESLIYYQSLPQQVSKFNRGSSAYFRKLSNWDTRKSETEFKPAMASGINYRLIRLADIYLMYAECLIKGGASDGNVQSAINAINKVRHRAGVVLIGKSEQGEFKRYTYDEKEYAASDVMNHLMYVERPLELCMEGHAIRVIDLRRWNITKERFDQLASDEYKYCMIQTKYLKPNPDDPNALVSAFNFGKQYRFYELPPEKRGNAFVDYFQASLNYGPQVAYWPIPNIEITSNPDINK

SEQ ID NO: 26 - protein, 1032 aa, Bacteroides Plebius
MRNQKKWYHGRYMLFVMLIFYTLSMYSQKITVKGKVIDAANNLEVIGAAVQVEGTSLGTITDMDGNFVLQGVPTKGNLVFSFVGYKTVKAAIKNGQIYNIKLQEDTKVLDEVVVVGYGSMRKKEVTGAVARVNSDEITKISTSDLGTALQGMVAGVNVQASSGEPGAKSNIQIRGLSSISGDSSPLYVVDGVPFEGDPGLSSSEIASIDILKDAASAAIYGTRGASGVILITTKKGKEGEMKIAVDGYYGVQHITSNIHLLDANESIFVKVMSNRMMEGNQNTDDLAWSNLKTYPVNFFNNSSLYEYVVNNNAPIQNYSVTANGGKKDLTYNLTANYFDQKGVLINSDYKRYNIRSNTHFQRGKWTINTNIAMKIENQLSPAWGLLNECYDYSPTRSQIYPQASIVNAAGDPADLQGVSYTLGRLKEENHKDTESFNGNFYLAYNVIPGLNVSTRLGFGYNNQKAVSIRPEFEVYNQKGEKVTSSNYRSQLKDTHSKNTSLTWETMVNYNKKIKKHDIKFTGVFSMEKYTYEMFYASIMDLVTNEIPNLNAGTSDMTVGTGSGQWGQDRISTMVGMLGRLQYSYADKYMASASIRRDGSSKFSEENRWGLFPSLSVGWNISEESFFDRFRWLVNSLKLRFSYGTTGNQNFPDYSYAPAIYKNYDYTFGTGTSEILANGFTQLGFANPNVKWETTQQLNAGIDMALYNNKLILGLDLYKSNKKNMLFPMVVPPSNGGGQSSTVTLNAGDMENRGVEFSLTHRNKIRGVNYSLTGTFTKNVNEIVSMAGKNELYFFPDGKPVSSGSDYVTAIKKGYEAGAFFVMPTAGVINTEQKLAEYQKLQSSARMGDLMYIDTNNDGVLNDDDRVYAGSGMPDYELGLNFSADYRGFDFSMNWYASVGNEIINGTKIYTYQRRTNKELIYMWTPTNYTSTIPSYRTEGHNNYRAHTDMWIEDGSFVRLKNIMLGYSFPKSWVSKLGLGKFRLYVAADNLLTLTKYDGYDPEVGSNGLSRRGLDYGTYPISIQMRGGFQINF

SEQ ID NO: 27 - protein, 1271 aa, Bacteroides Plebius
MATNDGLNRFDGYEFKVYGYQSNGLNSNLIVCIDEDSHGNLWIGTADRGVFLFNSVKNEFVSLNLGHSGIDKNFTCDKILVDSKDRVWFHSSDESIYLVNYDFQNGKINTVLRSTLKLPYISDIIEIDNTIMLSSEDGLYECNVDGDELLLNKLLGCPIASAIVISSSQILYSNLENHQLCLYDKHTCKVSTLLENCDIRKMVYKNKRLFYATTSTVNVLTFDVLHAIESKPQVIATYSYSYPQTVVLDKNDILWIGFFKSGFMSIRENNKPIDLFRGIGNDHISSVYTFAKSDIYLGTEGSGLYHFNSITGNARLIPFTANRIVYSTAYSNYTDCMYVSLMYDGIYSFTSDNDYKKISGLRNVRAMLADGKYLWIGTYNKGLFRYDLSTGVMKEIKTSDNKELKIVRNIIKDHKGNIWVASSFGLKVLESADLYIDNPVLNSVKGLDELDYIVPVCEDLNHNIWYGTLGRGLRKIVDLDENHNACVENFSSADGLSSNTIKSIVNGTDGTLWISTNKGINSLNINTQRIRSYDIFDGLQDYEFMELSAGVMTDGTMIFGGVNGINVFRPNDFDVIDFNGSPTLVDFKIFNHSVEADSTYSAYFDKSVSFTEHIELPYNLNTFSFQFSSLDYRSPYKVGYEYMLEGVDDSWISTSAFHREAFYTKLPSGEYMFRLRVRNSDGVYSLNELSIPVIINPPFWRTWYAYTLYFILLVLSLYRFKVYYTSRVQRRNALYIANMEKRKTEELLEKETTFFTNISHELRTPLTLIHSPLSMIIESGKYSSDKYLAGMLQTMEHNSKFLLSLVNQLMNFSKSEKGMLSLNLKYGNFSSFSKEVFQQFTYWAKQKGVGLEYSVSRSDISFLFDPHLMEQIIYNLVSNAIKHTPAGGFVSFTVNEQDNKINISVADSGNGISDNLKTHLFERFYSQNKNSAEGGTGIGLFLTKRLVEIHNGNITFVSEEGKGTVFHVVIPMITEGDMVTENISANSGEDEKFADVLRSESCEHEEMIDIEVDGESPAILIVDDNKDICNMLSLLLSDKYKIMIAHDGEMAWNMIPDLQPDLVLSDIMMPGMNGLELCERIKQDVRTSHIPVVLLSAKTTLQDYFIGYKFHADAYCPKPFDNKIMKELLNSIITNRKRILQHKKVPAIKISEVSTTSTDDKFLEKLVKIIEDNITDSSFQIEDICKGLGVTALVLNKKLKALMGVTANAFVRSIRMKRAAELLKTGRYSVSEVTYDVGFNDLKYFRECFKKEFGVLPQQYKEQSIQTDLDS

SEQ ID NO: 28 - protein, 390 aa, Bacteroides Plebius
MDNNFVFGYNIPTKILFGCGELKRLSTETLPGKKALIVISSGTSMRKYGYLDKVIGLLKENNVDAVVYDKILPNPIKDHVMEGTAICREENCDMIIGLGGGSSIDTAKSIAIMACNDGDYWEYVEGGTGKGLPYSKALPIIAIPTTAGTGTEADPWTVITNLETNEKIGIGSTLTFPCLSIIDPELMVSVPPHLTAYQGFDAFFHAAEGYIANCATPISDIFALEAIRLLYKYLPVAVKDGNNLKARAKVAWASTLAGMVESTSSCTSEHSLEHALSAYYPALPHGVGLIAISEAYFSTFIYDRTKRYMRMADVMTGCKNLNPEHFIDALVRMQKECNVRDLKLSDWGIVKEDFPKMIDNARTAMGALFSLDPHELSDTEILDIYIKSYR

SEQ ID NO: 29 - protein, 536 aa, Bacteroides Plebius
MKTNLKNNIMKGMAVMPFLSVCVGVAAQQKQMNVIYIMSDDHTSQAIGAYGSRLAVLNPTPTIDELARDGMLFENCFCTNSISTPSRACIMTGQYSHRNKVLTLDEVLQPDQEYLVDEFHNMGYQTAMIGKWHLGCEPSHFDYYSVFNGHGGQGEYFDPIFLTSDVTDKKWPNNQIKKMGYSSDIVTNLAIDWLKNRRDKSKPFFMMHHYKAPHDMFEYAPRYEYYLDDVEVPVPLSLFDTDKWGSEGTRGKNDSLRHFIGTSVSSRHEIRNYVMEYKCNTGDEMENTYLAYQHYLKSYLRCVKGVDDNLKRLFDYLKKEGLWENTIIVYTGDQGMMLGEHDLQDKRWMYEESQRMPFIVRDPRCPYKGAKSDLMINNIDFAPTLIEMVGGKEPSYMDGKSFASVFEGKKPENWKDAVYYRYWMHMIHHDVPAHIGIRTENYKLILFYGRHYDDKRYGQKSMSWLKNSHKIVPTPVSFELYDVKNDPYEMVNLADNPKYAKVLKDMKKKLRELRKQVGDTDEAYPELKKVIDEALR

SEQ ID NO: 30 - protein, 519 aa, Bacteroides Plebius
MKTVLGVAALSLLASCNSTYAPNVDSTVSLKGTDVFKADSASIAQNYTIPEWFKDAKFGIFIHWGVYSVPAYGSEWYSRWMYKEGHPINKYHVQTYGPLTKFGYKDFIPMFKAENFNADEWLAVVKSSGAQYIVPVAEHHDGFAMYSSTFNKWNAVDMGPKRDIIGELKEATKKAGLRFGLSSHRCENAWFYEYGMETPSDVQDTTITLYGERLHEPEGQGMTPYCGKYEGSNERSRRQFLMHTYELIDKYQPELIWFDWTVGKYPFQPTFYKFMAYYYNSALDWNKEVVVNTKFGYGDNIQVFDIERGKSDRIREYPWQTDTSVGKKSWSYCVGEENKSPDHIIDDFVDIVSKNGNLLLNIGPKADGTITDEQKNVLAEIGKWLKTNGEAIYGSRPWVIAFEGHNAGTAGYMTDNTKTEYTADDIRFTTRDNNLYAVSLAWTDGSVTIKSFAPKYCQNVEIESVEMLGSSEKIDYKMTDEGLVVNFPKNKPTEYAHVFKIKLKGAVVSKPLYDKVDNG

SEQ ID NO: 31 - protein, 299 aa, Bacteroides Plebius
MKNYLIYLLAAVSCTTVADLNAQVSTKTGNETTELTIPKKFYKDSIDFSNAPKRLNNKYPLSDQKNEGGWVLNKKASDEFKGKKLNEERWFPNNPKWKGRQPTFFAKENTTFEDGCCVMRTYKPAGSLPEGYTHTAGFLVSKELFLYGYFEARLRPNDSPWVFGFWMSNNERNWWTEIDICENCPGNPANRHDLNSNVHVFKAPADKGDIKKHINFPAKYYIPFELQKDFHVWGLDWSKEYIRLYIDGVLYREIENKYWHQPLRINLNNESNKWFGALPDDNNMDSEYLIDYVRVWYKK

SEQ ID NO: 32 - protein, 531 aa, Bacteroides Plebius
MFAAIASSSCSDSFLDTAPIMSETESSFYRTDEQMFKALTACYDPLAHIGGASGNALASIVPMGEIRSDNARTGGGSDQDQPYMQAIEDYSNTSVNSISDNLWKTRYRGIYRCNLVINSEYDSPEAKVYKAEAKFLRAWYHFELLRYYGPCFISLETLYPEGFKFTRDTRENVNKAIEKDLLEAIPSLKDNFPDTMKGRITKTAAQALLAKVYLYWADWSNDDAKIFDKAKPLLEDVISSGNYTLTDDYSKLFAAHQENNEESIFEIQTSTKSGNTNWGNIDAGEGAMWVTFCGPRQLKNSPDYDNGYGFCLPTKELYDYFLPDDHVRRDAAIFTYDELVTKPNANIQDESKKVVWETGSYGPDFQGYAQKKYPPFKNYDMIGNPNLNKPGNVRVIRYGEVYLMLAEAYLRGTNPDEAKAKYYINELRKKHVHADDGSYIDVDKLMQMYPDRFKSVIDVLWYERRCELACEGDRWFDLVRSGRAEEVMMPILRRDYGISAWSKKFNYLPIGSIEISNSGNSLTEYPDEVNE

SEQ ID NO: 33 - protein, 982 aa, Bacteroides Plebius
MIGASILVKGTTNGIISDLDGNYILENVPMESTLIYSFVGYDTQNIVYKGQSKIDVQLKTSAIALEEVVAIGYEVKKKSVVTGAISSIDSDDLLQSKPANAVNALSGRVSGVNVVTNSGQPGTAPKLVIRGVGTNGNSNPLFVIDGLPMDDMNSVNPNDIESMEVLKDATSAAIYGARAANGVVLITTKKGKKGKTSLAYDGYYGFSTVAKKPTMLNDEQYIMLMKEFADNDDMPLAGGVPTAPTGYNTDWFNEILNTAPVTEHNITANFGSDKGSSLLSLNYLDQNGIIGEDASFYKRFSTRLNSSYSINDFLSVGANVNYAYIENSGVATGINGYNPISYAYNIDPTTPVYDENSNDTFGYGVSPVPYSRMWNPIAFMDEAPKNKNITQQFFGNVYAEITFIKDLVFRTDFGINHRNFRGRMFAPKFFHSAECKEDNSRVEQSTNANSSWQWENTLRYKKSFGEHSTSVLLGTSASRDVYEFMAGTRNKYPNEAMTNENYWYLNAGDVMTSANSGGANPRHSMFSYFARLSYNYAEKYMAEVVVRRDGSSNFGPNNRYATFPGVSLGWNVSNEKFWKIKNFDVFKLRFSWGQNGNERISPFSYTSIIGNNYNYTFGNAITVGSAPNNLVNPDVKWETSEQFNVGADMTFYNGMIRASFDWFKKSTKDLLFQPTVEAIRGNNAAFRNLGNITNQGVEMQMTFNKNWNEINFSISANASYLKNEVVKIGNVNGYTDGGSWRTSVNVTRMEEGHAMGYFRLYKNLGIFQNEEQIQNYKSKDGKVIQPDAVPGDFIWQDTNNDGQITDEDRTDCGNPWPKWTFGLNLGADWRGIDMTIFLTGKAGYKVFSDIYRQEAYGRSNLPSFYLDRWRKEGDDNGVPRLSSKDPNGNFGKPSDFYLYDGSHLKISSLEVGYSFPTKLINKLMLNKARIYAAIDNLATFTSYPFMDPEVGNMAGGNILSTGIDYGTYPQARTFRFGLSLNF

SEQ ID NO: 34 - protein, 1086 aa, Bacteroides Plebius
MQFLSASDNGANQWRNNQNVWQDQTINGINRLPSRSTTYSFRRVDWALDGDREKSEYMSLNGQWKFNFSEDMALAPAGFYKVEYNSSSWKTIPVPSCWEMQGYGYPIYTNTIYPFPARPPYIDRNNQTGCYIKEFVVPDKWKSDRIILHFGGVYSGFNVWINGQKVGYSEDSCLPTEFDITEYVKKGENKLAVQVYKWTDGSYMEDADHWRMAGIHREVYIMSIPQVAIYDYGVRTRIDFRKNIARLQIRPEITNQNMDDLKGWNLSAQLYDADGKPVFGKDITVTADYVVNEPYPQRDNVYYGMMEGIVSKPKLWNSEHPYLYTLVIKLTDKKGNVVDARSNKVGFRDIKITGNQILVNDTPIKLIGVNRHDHSETGGKTVTRDEMLEDVLLMKRYNFNTVRTSHYPNDPYFYELCDKYGIYVMDEANLETHHQRGYLSNRPEWANSFMERVVRMAVRDRNHPSVFMWSLGNESGCGPNHAALSGWLKDYDPTRPVHYEGAQGQPENPLYKPIGRKEASIVTSEIDFNVNEDVKPAKKELCVYANPDDPLYVDVISRMYPMVDELIAMTKNPVMNRPIIMCEYAHSMGNSTGGLKEYWDAIRSHDALAGGYIWDWIDQGLLDNERKYNKKSWNYGGDYEKGEHNDQNFCINGVISADRSIKPATEECKYVFAPVSFTTDNVYSGEITVKNRNFFLSTDEYRYFWQLKDEDSVLQEGEIIVPTTPAGESCKLKLPIQNFKADDGAEYWLFLSARLKNDNLYAKAGYEVAWEQFKYLSLPKIVECVDTTLDMEIDSDNKKDISVKGKNFYLNISDGYISQYKIDNESIITSALKPNFWRASTDNDWRGWKVDRLFAFWKDAPLKLKTVSIDVRKSEGNLEVKVLKAIDERLRLTLNYKVKADGTIGVHYSMMKSPEISEMLRVGLQCECTNRLSDVTYYGRGPWENYSDRKASAMVSIYNCKVSALGFDYVMPQENGNRCDVRWFALQSDKAGVMIVGDEPLSVSVWEMSQNAIDKAKHINELEKDLYSNTLNIDLVQAGVGGTDSWSLKARPSIDKRLLKGSYSYGFTFVPLGRDANLKEMGRKIY

SEQ ID NO: 35 - DNA, 20 bp, Artificial sequence
  Synthetic sequence
gggtacagaaaatctcggtc

SEQ ID NO: 36 - DNA, 20 bp, Artificial sequence
  Synthetic sequence
ttcatcatgtcgtacgaagg

SEQ ID NO: 37 - DNA, 20 bp, Artificial sequence
  Synthetic sequence
tacttccatttggggtgaag

SEQ ID NO: 38 - DNA, 20 bp, Artificial sequence
  Synthetic sequence
tacagtccctttggacaatg

SEQ ID NO: 39 - DNA, 23 bp, Artificial sequence
  Synthetic sequence
catactttagcatcgtcgaaaag

SEQ ID NO: 40 - DNA, 20 bp, Artificial sequence
  Synthetic sequence
tttccatttccaggattccc

SEQ ID NO: 41 - DNA, 20 bp, Artificial sequence
  Synthetic sequence
gtagctccggtgacatttac

SEQ ID NO: 42 - DNA, 20 bp, Artificial sequence
  Synthetic sequence
tctttagctgaagaaacggc

SEQ ID NO: 43 - DNA, 20 bp, Artificial sequence
  Synthetic sequence
aagcttgcgtatgtcgatag

SEQ ID NO: 44 - DNA, 20 bp, Artificial sequence
  Synthetic sequence
ttatcgccattcttcagcag

SEQ ID NO: 45 - DNA, 20 bp, Artificial sequence
  Synthetic sequence
tggcatccgacgaatataag

SEQ ID NO: 46 - DNA, 20 bp, Artificial sequence
  Synthetic sequence
tttggaataggccagtatgc

SEQ ID NO: 47 - DNA, 20 bp, Artificial sequence
  Synthetic sequence
aggtaaaggcactgttttcc

SEQ ID NO: 48 - DNA, 20 bp, Artificial sequence
  Synthetic sequence
atatagccggagattctccg

SEQ ID NO: 49 - DNA, 20 bp, Artificial sequence
  Synthetic sequence
catctacatcatgtcggacg

SEQ ID NO: 50 - DNA, 20 bp, Artificial sequence
  Synthetic sequence
ctgtccggtcatgatacatg

SEQ ID NO: 51 - DNA, 20 bp, Artificial sequence
  Synthetic sequence
gattctcttggggacagaac

SEQ ID NO: 52 - DNA, 20 bp, Artificial sequence
  Synthetic sequence
agtttcccatttcacgtctg

SEQ ID NO: 53 - DNA, 81 bp, Artificial sequence
  Synthetic sequence
atttatctatccattcagtttgatttctcaggactttacatcgtcctgaaagtatttgttttttgggtgttgatatggcag

SEQ ID NO: 54 - DNA, 83 bp, Artificial sequence
  Synthetic sequence
atttatctatccattcagtttgatttctcaggactttacatcgtcctgaaagtatttgttaatcccaatacagtctgttactg

SEQ ID NO: 55 - DNA, 79 bp, Artificial sequence
  Synthetic sequence
gtgagttgattgctacgtaaataacttcgtatagcatacattatacgaagttatggactacgcaggtcaatatccggaa

SEQ ID NO: 56 - DNA, 78 bp, Artificial sequence
  Synthetic sequence
gtgagttgattgctacgtaaataacttcgtatagcatacattatacgaagttatggactaggtaaacctccccgatgg

SEQ ID NO: 57 - DNA, 88 bp, Artificial sequence
  Synthetic sequence
gtgagttgattgctacgtaaataacttcgtatagcatacattatacgaagttatggactatttagaacatatttttccgatttgccag

SEQ ID NO: 58 - DNA, 24 bp, Artificial sequence
  Synthetic sequence
aaacagcattccaggtattagaag

SEQ ID NO: 59 - DNA, 80 bp, Artificial sequence
  Synthetic sequence
cactgcccgctttccagtcgggaaacctgtgcggccgctttccttctttctctcttctggcagtatagcgaccagcattc

SEQ ID NO: 60 - DNA, 5853 bp, Artificial Sequence
  Synthetic sequence
gataaaacgaaaggctcagtcgaaagactgggcctttcgttttacaattgggctaccttttttttgttttgtttgcaatggttaatctattgttaaaatttaaagtttcacttgaactttcaaataatgttcttatatttgcagtgtcgaaagaaacaaagtaggactgatcacacaacatttaaaaaataacattatgaaagcactcgaaaagagattcaaaggtaatattaacaataatttattttcaatgcgtaaaggcgaagagctgttcactggtgtcgtccctattctggtggaactggatggtgatgtcaacggtcataagttttccgtgcgtggcgagggtgaaggtgacgcaactaatggtaaactgacgctgaagttcatctgtactactggtaaactgccggttccttggccgactctggtaacgacgctgacttatggtgttcagtgctttgctcgttatccggaccatatgaagcagcatgacttcttcaagtccgccatgccggaaggctatgtgcaggaacgcacgatttcctttaaggatgacggcacgtacaaaacgcgtgcggaagtgaaatttgaaggcgataccctggtaaaccgcattgagctgaaaggcattgactttaaagaagacggcaatatcctgggccataagctggaatacaattttaacagccacaatgtttacatcaccgccgataaacaaaaaaatggcattaaagcgaattttaaaattcgccacaacgtggaggatggcagcgtgcagctggctgatcactaccagcaaaacactccaatcggtgatggtcctgttctgctgccagacaatcactatctgagcacgcaaagcgttctgtctaaagatccgaacgagaaacgcgatcatatggttctgctggagttcgtaaccgcagcgggcatcacgcatggtatggatgaactgtacaaaggatctgattacaaggacgatgatgataaggactacaaagatgatgatgacaaagattataaggacgatgatgataaaggtcatcatcatcatcatcactaaatcctagctgattagctcgagaaggccatcctgacggatggccttttttttgactagcggccgcgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcagtcattggtaactatctatgaaactgtttgatacttttatagttgattaaacttgttcatggcatttgccttaatatcatccgctatgtcaatgtagggtttcatagctttgtagtcgctgtgtcccgtccatttcatgaccacctgtgccgggattccgagagccagcgcattgcagatgaatgtcctttttcctgcatgggtactgagcaaagcgtatttgggtgtgacttcatcaatacgttcatttcccttgtagtaggtttcccgtacaggctcgttgatttctgccagttcgcccagctctttcaggtaatcgttcatcttctggttgctgatgacgggcagagccatgtaattctcgaaatggatgtccttgtatttgtccagtatggctttgctgtatttgttcagttcaatcgtcaggctgtcggcagtcttgactgtggttatttcgatgtggtcggacttcacatcgcttcttttcagattgcgaacatccgaataccgcaaactcgtaaagcagcagaacaggaaaacatcacgcacacgttccaggtattgcttatccttgggtatctggtagtctttcagcttgttcagttcatcccaagtcaggaagattacttttttcgaggtggttttcagtttcggtttgaacgtatcgtatgcaatgttctgatgatgtcctttcttgaagctccagcgcaggaaccatttgaggaatcccatttgcttgccgatggtgctgtttctcatatccttggtgtcacgcaggaagttgacgtattcgttcaatccaaactcgttgaaatagttgaacgttgcatcctccttgaactctttgaggtggttcctcactgctgcaaatttttcataggtggatgccgtccagttattctggttaccgcactcttttacaaactcatcgaacacctcccaaaagctgacaggggcttcttccggctgttcttcactggtatctttcattctcatgttgaaagcttccttcaactgttgggtcgttggcatgacctcctgcacctcaaattccttgaaaatattctggatttcggcatagtatttcagcaagtccgtattgatttcggctgcactttgctttagcttgttggtacatccgttctttacccgctgcttatctgcatcccatttggctacgtcaatccggtagcccgttgtaaactcgatacgttggctggcaaagatgacacgcatacggatgggtacgttctctacgattggcacaccgttctttttccggctctccaatgcaaaaatgatgttgcgcttgatattcataattgggtgcgtttgaaattctacacccaaatatacacccaattattgagatagcaaaagacatttagaaacatttacttttactctatattgtaatttacacttgattatcagtcgtttgcagtcttatgatattctgtgaaagtataagttcgagagcctgtctctccgcaaaaaacgctgaaaatcagcagattgcaaaacaaacaccctgttttacacccaagaatgtaaagtcgggtgtttttgttttatttaagataatacaaccactacataataaaagagtagcgatattaaaagaatccgatgagaaaagactaatatttatctatccattcagtttgatttctcaggactttacatcgtcctgaaagtatttgttgtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagggcgcgccagtag

SEQ ID NO: 61 - DNA, 7148 bp, Artificial Sequence
  Synthetic sequence
ttcttgccgcctttcattatttccttcattaccgggcggttggaaagccaaaaagtagacgacatggtagtgagcgaagccttcatccttgtttcataatacccataatgtgcctggttctttgcagaagcaaccgctccaccggcaagacgatatttatcgcccggctttccatcaagtccttctgttggcgacaaaacggtattgattatacgaagacaacctttcttgacactaacattctctgccttgaaagttgcaggcggccgaccgttagtccaataaggacttttagcatgccatttagcggcattaagacgtttaccattgaattcatcagtataatcttcgttaactacccatttataaccctcaggagcctcaggcaaattttttatatgctcttcagccaaagaatattccttatcattttttaatgtataagatgacaggaataaagatgcagcagataaatacaatactgtttttctcataaactttgtcgttttagattttttgttacacgacaaaagtatataagtttcatgaaagcattaagggggatttacatcgtaaaaggtggggtaaaattctaccactccctgaaacacaattatttcactcatgaaaccatgtgtttttacgatatataaaacccgacagaagaataataccgtattaccggctaatttacataagaataacttttcaaaccgccatataccccactttacgtccgtaccctcagtcctcgactccggcaatatgttttccatatcgagatctatggttttctgcctcggattcaaccactaactgtcgagcatgtggattgcgtatctgtcatagaatctctttccgaaccatattatctcgtctgtgctaagtatgttgttcagacggataatctttccggtattttaccacctacttctcttgcaaatcctgatctgatataaccggatactctcaattcattgatttccgacttgtatacagtctgcgaagaggcattgaaactactgcacagactgaacagcagcaggggaataatttaactgattttaatagtagacattctgtgttcataatatttcattttaatgattacgtttctgactttcgtctgatgcaaaattatgaggtatcggacggggttgtatctttcagtaaaaatcagtaaagtcttggcaaggggtaaaaaacttaacatcttgtatataaatatattacaaacaaggtgcaaagattttcagtaaacgatggcgaatacagaacctatatatttacacgccataaaatgaagaaaaagcagtaggaaaaaaatgcgggcaagttccggataaaatgtgggcaagtttaaggtaaaacttgcccgcattttagatagaatgcgatcgcatttaaaacaagtaaaaaacgaagaaaaaaaatatgtgttcttcacagaacacatatttcaaaaataggtataaacacgctaaacaatgttaacaaaatataactattattctttatatttcatcaagattacaaagttattgattttatctaaaacatcaagtatttacagtagttaatagataattatagatattttccactttagaatgcgtatcaaaatcaatcaagaaaaaaataaatctttaacttcatttcatagtataaaacaaaaaaagcatcgtaccattacactcaataatagatacgatgcccgaaagaaattacagtaacagactgtattgggattgttcttaaaaagacttatctgtatgactttatatatatgtcgagtatttcggtatccgacagttcatgagggtccagactgaacaatgcacccatggcagttcgcgcattatcaatcatcttagggaaatcttcctttactattccccagtcgctaagcttcaaatcgcggacattgcattccttctgcattctcaccaaagcatctataaaatgttcgggattaaggttcttgcatccggtcataacatctgccatgcgcatatatctctttgtcctgtcataaataaaagtagagaaataggcctcgcttatagctatcaggccaacaccatgaggaagagcgggatagtatgcgctgagagcgtgctcgagagaatgttcggaagtacaactggatgtggattcaaccattcccgccagcgtacttgcccaagccacctttgccctcgctttcaggttatttccatccttcaccgcaacaggtaaatatttatacagcagtctgatggcctcaagagcgaaaatatcacttattggggttgcacaattggcaatatagccttcggctgcatgaaagaatgcgtcgaatccctgataggcagtcagatgtggcggaactgaaaccatcagttccgggtcgattatcgacagacatgggaaagttaaagtggagccgatacctatcttttcgtttgtttccagattggttatgacagtccatgggtcagcctcggttccggttccggctgttgtaggaatggctatgatgggcaatgctttgctgtaaggaagccccttgccggtacctccttcaacatattcccaataatcgccatcattacatgccatgattgcaatggatttggccgtatctatcgaacttccgcctcccaaacctataatcatatcgcaattttcctcacgacagattgccgtaccttccattacatggtcttttattgggttaggcaatatcttgtcgtacaccacggcatcaacattattttctttcagcagaccaatcaccttatccagataaccatatttacgcattgatgttccggatgaaatgactatcaaagcctttttgccgggcaatgtctctgttgaaagacgtttaagttcgccacatccgaagagaatcttcgtcggaatattataaccaaaaacaaaattattgtccataaatattatcagtcagtcaacttactatcttaaagcctcatcaatcactttcttgagttcaggaaacagcggccgcgcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattcccatgtcagccgttaagtgttcctgtgtcactcaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttcagatcctctacgccggacgcatcgtggccggatcaattccgttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcatatgttttaaatagagtttatatcttctgtccgtcctctccccgtgcacggaggtagcactccctgcaaagcggctcgtattcggctgtctctcctagaagtacctgcttgtcattcttgacggtacgatgagagaaagatgccagatcaccgcacttcacgcagatcgcatgaactttggaaacttcatcggcaatggcacataattgaggcatcggtccgaagggattccctttaaagtccatatccagtccggcgatgatgacacggatgccgttattggcaagctgcctgcatacgtcaatcagtccgtcatcaaagaactgtgcttcgtcgatgccgactacatctatttcagaagtgaacaacaggatactagccgatgaatcgataggggtggacgcgatggaatgactgtcgtgtgataccacatcttcttccgaataacgggtgtcgatggccggtttgaatatctctacacgctggcgtgcgaacttggctctcttcatcctacgaatcaattcctccgtctttccggagaacattgaaccgcagattacctctattctacctcttcttctggtttcttgtatgtgatcttctgaaaataataccatgtgatttttgtgctttcttgattaaataaatgagtggacaaaggtaaacaattcgatgtacaagaactgttaaattatccattattttaagttattgcataaattattcctacattcgcaccataataacaatggatggaaatgaaacagaagctattaacagatattgagctggatgttcatgagctgaagctactcatgaatacgttttctaaagagccgactcagactttgtctgaactgttgaagcggagcatcctacgtatgcaggagcgtttggaacagttgtcggaagagataagtgctgtgccggtggaagcctcgccttctcctgtagcggaagcggaaagtgaagcccccattgttgaagaacaagcccctgtaatagaggaagttgaatgtccggtgatagaagagaaggtcgtggaagagaatgaagcgacagcaccgggagaagatgaacctgtgatagtacaggaaccgcagactgttgtggaagagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctggagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagggcgcgccatcaa

SEQ ID NO: 62 - DNA, 32364 bp, Artificial Sequence
  Synthetic sequence
aacaaatactttcaggacgatgtaaagtcctgagaaatcaaactgaatggatagataaatattagtcttttctcatcggattcttttaatatcgctactcttttattatgtagtggttgtattatcttaaataaaacaaaaacacccgactttacattcttgggtgtaaaacagggtgtttgttttgcaatctgctgattttcagcgttttttgcggagagacaggctctcgaacttatactttcacagaatatcataaaactgcaaacgactgataatcaagtgtaaattacaatatagagtaaaagtaaatgtttctaaatgtcttttgctatctcaataattgggtgtatatttgggtgtagaatttcaaacgcacccaattatgaatatcaagcgcaacatcatttttgcattggagagccggaaaaagaacggtgtgccaatcgtagagaacgtacccatccgtatgcgtgtcatctttgccagccaacgtatcgagtttacaacgggctaccggattgacgtagccaaatgggatgcagataagcagcgggtaaagaacggatgtaccaacaagctaaagcaaagtgcagccgaaatcaatacggacttgctgaaatactatgccgaaatccagaatattttcaaggaatttgaggtgcaggaggtcatgccaacgacccaacagttgaaggaagctttcaacatgagaatgaaagataccagtgaagaacagccggaagaagcccctgtcagcttttgggaggtgttcgatgagtttgtaaaagagtgcggtaaccagaataactggacggcatccacctatgaaaaatttgcagcagtgaggaaccacctcaaagagttcaaggaggatgcaacgttcaactatttcaacgagtttggattgaacgaatacgtcaacttcctgcgtgacaccaaggatatgagaaacagcaccatcggcaagcaaatgggattcctcaaatggttcctgcgctggagcttcaagaaaggacatcatcagaacattgcatacgatacgttcaaaccgaaactgaaaaccacctcgaaaaaagtaatcttcctgacttgggatgaactgaacaagctgaaagactaccagatacccaaggataagcaatacctggaacgtgtgcgtgatgttttcctgttctgctgctttacgagtttgcggtattcggatgttcgcaatctgaaaagaagcgatgtgaagtccgaccacatcgaaataaccacagtcaagactgccgacagcctgacgattgaactgaacaaatacagcaaagccatactggacaaatacaaggacatccatttcgagaattacatggctctgcccgtcatcagcaaccagaagatgaacgattacctgaaagagctgggcgaactggcagaaatcaacgagcctgtacgggaaacctactacaagggaaatgaacgtattgatgaagtcacacccaaatacgctttgctcagtacccatgcaggaaaaaggacattcatctgcaatgcgctggctctcggaatcccggcacaggtggtcatgaaatggacgggacacagcgactacaaagctatgaaaccctacattgacatagcggatgatattaaggcaaatgccatgaacaagtttaatcaactataaaagtatcaaacagtttcatagatagttaccaatgactgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaacggaattgatccggccacgatgcgtccggcgtagaggatctgaagatcagcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctagctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgccagaagagagaaagaaggaaagcggccgcacaggtttcccgactggaaagcgggcagtgagcgcaacgcaattaatgtgagttagctcactcattaggcaccccaggctttacactttatgcttccggctcgtatgttgtgtggaattgtgagcggacaacaatttcacacaggaaacagctatgaccatgattacgccaagctatttaggtgagactatagaatactcaagcttgcatgcgatacgtatcgttaacgatggatccgacgcacgtgcgaattcgccctatagtgagtcgtattacaattcactggccgtcgttttacaacgtcgtgactgggaaaaccctggcgtcacccaacttaatcgccttgcagcacatccccctttcgccagctggcgtaatagcgaagaggcccgcaccgatcgcccttcccaacagttgcgcagctgaatggcgaatggcgcctgatgcggtattttctccttacggcggccgcttgacataacttcgtatagcatacattatacgaagttatgtttaaacattagcagaaagtcaaaggcctccggtcggaggcttttgactaaaacttcccttggggttatcattgggtcgagaccgcctgaagaggacttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaagcaacttcagacaatacaaatcagcgacactgaatacggggcaacctcatgtcgcctgaagagtgagaccgtcccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaaaatgtaatcacctggctcaccttcgggtgggcctttcacacttgcatcggatgcagcccggtgaacgtgccggcacggcctgggtaaccaggtattttgtccacataaccgtgcgcaaaatgttgtggataagcaggacacagcagcaatccacagcaggcatacaaccgcacaccgaggttactccgttctacaggttacgacgacatgtcaatacttgcccttgacaggcattgatggaatcgtagtctcacgctgatagtctgatcgacaatacaagtgggaccgtggtcccagaccgataatcagaccgacaacacgagtgggatcgtggtcccagactaataatcagaccgacgatacgagtgggaccgtggtcccagactaataatcagaccgacgatacgagtgggaccgtggttccagactaataatcagaccgacgatacgagtgggaccgtggtcccagactaataatcagaccgacgatacgagtgggaccatggtcccagactaataatcagaccgacgatacgagtgggaccgtggtcccagtctgattatcagaccgacgatacgagtggtaccgtggtcccagactaataatcagaccgacgatacgagtgggaccgtggtcccagactaataatcagaccgacgatacgagtgggaccgtggtcccagtctgattatcagaccgacgatacaagtggaacagtgggcccagagagaatattcaggccagttatgctttctggcctgtaacaaaggacattaagtaaagacagataaacgtagactaaaacgtggtcgcatcagggtgctggcttttcaagttccttaagaatggcctcaattttctctatacactcagttggaacacgagacctgtccaggttaagcaccattttatcgcccttatacaatactgtcgctccaggagcaaactgatgtcgtgagcttaaactagttcttgatgcagatgacgttttaagcacagaagttaaaagagtgataacttcttcaacttcaaatatcaccccagcttttttctgctcatgaaggttagatgcctgctgcttaagtaattcctctttatctgtaaaggctttttgaagtgcatcacctgaccgggcagatagttcaccggggtgagaaaaaagagcgacaactgatttaggcaatttggcggtgttgatacagcgggtaataatcttacgtgaaatattttccgcatcagccagcgcagaaatatttccagcaaattcattctgcaatcggcttgcataacgctgaccacgttcataagcacttgttgggcgataatcgttacccaatctggataatgcagccatctgctcatcatccagctcgccaaccagaacacgataatcactttcggtaagtgcagcagctttacgacggcgactcccatcggcaatttctatgacaccagatactcttcgaccgaacgccggtgtctgttgaccagtcagtagaaaagaagggatgagatcatccagtgcgtcctcagtaagcagctcctggtcacgttcattacctgaccatacccgagaggtcttctcaacactatcaccccggagcacttcaagagtaaacttcacatcccgaccacatacaggcaaagtaatggcattaccgcgagccattactcctacgcgcgcaattaacgaatccaccatcggggcagctggtgtcgataacgaagtatcttcaaccggttgagtattgagcgtatgttttggaataacaggcgcacgcttcattatctaatctcccagcgtggtttaatcagacgatcgaaaatttcattgcagacaggttcccaaatagaaagagcatttctccaggcaccagttgaagagcgttgatcaatggcctgttcaaaaacagttctcatccggatctgacctttaccaacttcatccgtttcacgtacaacattttttagaaccatgcttccccaggcatcccgaatttgctcctccatccacggggactgagagccattactattgctgtatttggtaagcaaaatacgtacatcaggctcgaaccctttaagatcaacgttcttgagcagatcacgaagcatatcgaaaaactgcagtgcggaggtgtagtcaaacaactcagcaggcgtgggaacaatcagcacatcagcagcacatacgacattaatcgtgccgatacccaggttaggcgcgctgtcaataactatgacatcatagtcatgagcaacagtttcaatggccagtcggagcatcaggtgtggatcggtgggcagtttaccttcatcaaatttgcccattaactcagtttcaatacggtgcagagccagacaggaaggaataatgtcaagccccggccagcaagtgggctttattgcataagtgacatcgtccttttccccaagatagaaaggcaggagagtgtcttctgcatgaatatgaagatctggtacccatccgtgatacattgaggctgttccctgggggtcgttaccttccacgagcaaaacacgtagccccttcagagccagatcctgagcaagatgaacagaaactgaggttttgtaaacgccacctttatgggcagcaaccccgatcaccggtggaaatacctcttcagcacgtcgcaatcgcgtaccaaacacatcacgcatatgattaatttgttcaattgtataaccaacacgttgctcaacccgtcctcgaatttccatatccgggtgcggtagtcgccctgctttctcggcatctctgatagcctgagaagaaaccccaactaaatccgctgcttcacctattctccagcgccgggttattttcctcgcttccgggctgtcatcattaaactgtgcaatggcgatagccttcgtcatttcatgaccagcgtttatgcactggttaagtgtttccatgagtttcattctgaacatcctttaatcattgctttgcgtttttttattaaatcttgcaatttactgcaaagcaacgacaaaatcgcaaagtcatcaaaaaaccgcaaagttgtttaaaataagagcaacactacaaaaggagataagaagagcacatacctcagtcacttattatcactagcgctcgccgcagccgtgtaatcgagcatagcgagcgaactggcgaggaagcaaagaagaactgttctgtcagatagctcttacgctcagcgcaagaagaaatatccaccgtgggaaaaactccaggtagaggtacacacgcggatagccaattcagagtaataaactgtgataatcaaccctcatcaatgatgacgaactaacccccgatatcaagtcacatgacgaagggaaagagaaggaaatcaactgtgacaaactgccctcaaatttggcttccttaaaaattacagttcaaaaagtatgagaaaatccatgcaggctgaaggaaacagcaaaactgtgacaaattgccctcagtaggtcagaacaaatgtgacgaaccaccctcaaatctgtgacagataaccctcagactatcctgtcgtcatggaagtgatatcgcggaaggaaaatacgatatgagtcgtctggcggcctttctttttctcaatgtatgagaggcgcattggagttctgctgttgatctcattaacacagacctgcaggaagcggcggcggaagtcaggcatacgctggtaactttgaggcagctggtaacgctctatgatccagtcgattttcagagagacgatgcctgagccatccggcttacgatactgacacagggattcgtataaacgcatggcatacggattggtgatttcttttgtttcactaagccgaaactgcgtaaaccggttctgtaacccgataaagaagggaatgagatatgggttgatatgtacactgtaaagccctctggatggactgtgcgcacgtttgataaaccaaggaaaagattcatagcctttttcatcgccggcatcctcttcagggcgataaaaaaccacttccttccccgcgaaactcttcaatgcctgccgtatatccttactggcttccgcagaggtcaatccgaatatttcagcatatttagcaacatggatctcgcagataccgtcatgttcctgtagggtgccatcagattttctgatctggtcaacgaacagatacagcatacgtttttgatcccgggagagactatatgccgcctcagtgaggtcgtttgactggacgattcgcgggctatttttacgtttcttgtgattgataaccgctgtttccgccatgacagatccatgtgaagtgtgacaagtttttagattgtcacactaaataaaaaagagtcaataagcagggataactttgtgaaaaaacagcttcttctgagggcaatttgccacagggttaagggcaatttgtcacagacaggactgtcatttgagggtgatttgtcacactgaaagggcaatttgtcacaacaccttctctagaaccagcatggataaaggccaacaaggcgctctaaaaaagaagatctaaaaactataaaaaaaaaataattataaaaatatccccgtggataagtggataaccccaagggaagttttttcaggcatcgtgtgtaagcagaatatataagtgctgttccctggtgcttcctcgctcactcgaccgggagggttcgagaaggggggtaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggtcggccgcggtgtctcgcacacggcttcgacggcgtttctggcgcgtttgcagggccatagacggccgccagcccagcggcgagggcaatcagcccggtgagcgtcggaaaaggaatattcagcaatttgcccgtgccgaagaaaggcccacccgtgaaggtgagccagtgagttgattgctacgtaaataacttcgtatagcatacattatacgaagttatggactatttagaacatatttttccgatttgccagattacaatcacaataaataaatcaacaactaaatctaattacctaatcttataactaaaccctcaaacaatgttatttaaccttttctatcttgacatcatcaagcaggaagcatccaccattacctgaacccggaacagctgtgaaacgatatacaaaaccattttcctgcaatttgaatttaactgttgtaagattgtaattcttacggtctttcttgacctcagcagtggcaatttcttccagtttctttgaatccggattatagtactcaatcctgaagttaggtttgtcaccccaactgtatttggtataagctgaaatctgatattctgctccagtttcatagctgatgtttacagcctgccacataccaaccttcacctcaacagcatagttgcctgaatgtgcctttttcgcatcaactattttgttatctttcttttcccagacattccatgatgtcaagtcacctgactcaaaatcaccgttcttaatttcctgagcgtatgcagaagtcatcatcattccgcaagccatcattgctaaaatttcttttttcattttttctaaggtttttaatttaagtattatgttgtatctattaaaatcactcttctattggaaccaacttataagccctgacccagtcataataagtagtacttttgtccttatccttcaagtcctcagctgtaggtacttgtttttcccaatcgtatgtttcagtaactatatgtatgaacataggtcggtcaaacggagtatctgtatattttgttgtaggcttgatagtgtacatatactttccgtcataatagaatttcacggtatttgcatccacccaccaacaaccgtaagtatggaaatcttctgccgatgggtccgtcatatacgaaaccacatccgaacgtttcgccgtattgtcagtacgtttgcctccttgttcctgataccaatagtgagtattactgttcatctgcatattccatgtcttgttccacggattatcagggttgacacttcttattatacccattgtttctataatatcaagttcctgactgctccatgtctttatcttcttgccgcctttcattatttccttcattaccgggcggttggaaagccaaaaagtagacgacatggtagtgagcgaagccttcatccttgtttcataatacccataatgtgcctggttctttgcagaagcaaccgctccaccggcaagacgatatttatcgcccggctttccatcaagtccttctgttggcgacaaaacggtattgattatacgaagacaacctttcttgacactaacattctctgccttgaaagttgcaggcggccgaccgttagtccaataaggacttttagcatgccatttagcggcattaagacgtttaccattgaattcatcagtataatcttcgttaactacccatttataaccctcaggagcctcaggcaaattttttatatgctcttcagccaaagaatattccttatcattttttaatgtataagatgacaggaataaagatgcagcagataaatacaatactgtttttctcataaactttgtcgttttagattttttgttacacgacaaaagtatataagtttcatgaaagcattaagggggatttacatcgtaaaaggtggggtaaaattctaccactccctgaaacacaattatttcactcatgaaaccatgtgtttttacgatatataaaacccgacagaagaataataccgtattaccggctaatttacataagaataacttttcaaaccgccatataccccactttacgtccgtaccctcagtcctcgactccggcaatatgttttccatatcgagatctatggttttctgcctcggattcaaccactaactgtcgagcatgtggattgcgtatctgtcatagaatctctttccgaaccatattatctcgtctgtgctaagtatgttgttcagacggataatctttccggtattttaccacctacttctcttgcaaatcctgatctgatataaccggatactctcaattcattgatttccgacttgtatacagtctgcgaagaggcattgaaactactgcacagactgaacagcagcaggggaataatttaactgattttaatagtagacattctgtgttcataatatttcattttaatgattacgtttctgactttcgtctgatgcaaaattatgaggtatcggacggggttgtatctttcagtaaaaatcagtaaagtcttggcaaggggtaaaaaacttaacatcttgtatataaatatattacaaacaaggtgcaaagattttcagtaaacgatggcgaatacagaacctatatatttacacgccataaaatgaagaaaaagcagtaggaaaaaaatgcgggcaagttccggataaaatgtgggcaagtttaaggtaaaacttgcccgcattttagatagaatgcgatcgcatttaaaacaagtaaaaaacgaagaaaaaaaatatgtgttcttcacagaacacatatttcaaaaataggtataaacacgctaaacaatgttaacaaaatctatttataaaaaaagctcacatcaataatatctgcaacatttttacaatactccataaatgaagagaccttgggatgatttatacacagagctatctgtgatgtaggcgaaaaacgtcctgtcccgtcaagaaacgctgtaagctcagatgggaggagtatactgccaatacctggatttacgtcagtcagaacgactgtatttacagcttccaccgctgacacatcaagataatcgagtgccggaagatctgcgaagtgcaattttcctatcatattgccgcctttgctgccctgaagagagacactctccaatgaagaacaaccggatatatggatttcactgtcgaatattgaagtttcggaaacatcatcattaagtataacagaaggaacaactaccaattgaagcgaactgttattctccaccctaagtactttcaatgatgatgcggaacttaaatccattcccaaaggtgtatcaatattagagattgaaaatactgaaactcccgaagacggcttgacatacgacatggaataatgcttggacttcactcccgaaatgtctacttttcctctgaaaccgggatttgacaatatatactccacaccctcaaggttagctgtctgcgacaggaaaatgaggtcgttcccttcggttatcctcttcgtgacatcaatctccaacgatgagacaaacaccgacgggaagtttctgtaaagatatgaacggagcaaaggatccggtactcttcggtttactgtatattcagtgtaatttccatcctcgtccgacatcacgacaagacatttgtccgtcatggctttatagaatgcaggtatgacatctgtattccattttgcaaagtaaggaagtttcagatttgtaagacttttacaaagcaccgtagtgccatcggttgaaataagattgagatacgaagttatgccgtcattgccgcgtaaagctaccgattttattccttcgggcaggtcagcaaagtcgaatatagaaaaactgttacactcaagattgacatctgcgagcgaaggaaaactcctcaaaccgctaatagatgtaagttcgcatctactcaagtccaaagaagtggtattgagaacttgattgtcacaaatcagctctccgttttcgctgaaattaaatcctttccgggtcaagacatcgcgtaactttgtatcaaaagtcacttcagacacttcaaagtcggaaatttctgtttcatccttacacgagattattgtgaaacagagaactatcagtacataaaagctaataaaattcctcataacaatcagttttgtggtaataagactatattatcaatccaagccgcgtcgttctgtctttcgcacacaatggcacacactacttttttcactgtagaattaaaatcgaaagatacggctttataattgccgggagaagaaaattcctctgtatataccgttcctgtagacatatcctgtagcatgactttcaacttacatgctccttcggtctttacatcagcagagaagcgataagtcctgccactctccatgtcaaccctctgcatgagtcctgcatgaccagatatacaggctacattattgcctgcattgtcagtctgtacgcaaaccgtaccatagttacccaatggctgccatgctgaaagtccttcgctgaaggttccattctgcaaggtagagacagtatatttctcaacctgcagtatcatggacgatacgtgacctcctccgtcggaaaaggtgatgtcgacattattatcgccattcttcagcagctgtatgtcgaacggtacttctatcataccgaaaaatatattgcggttgctctggccgtagcctttccagttgtcgggaacactcacagcggtaccattaatctttaccaccggtttcttggaagcagagacaggacggcctatcgacatacgcaagcttgctctgcccgaaccggactcgattcctgtgaaggggaacgaaagggatgatccggcggaaatcggtttcagatactcactgctgtaatatttattgcggattatggagttcgtgaatgctgacgaagacacatctgctacaaggactatggtctgatttgggacaattgagatgctttcaggcatggacgggacattctgttccgtatattctatacctgcgttataattgacatatagagaacgctttgtgacattcgatacatccttccagctattcttattgttcagatatacagtctgcgggttatcatcaagattatcaagggcgatatagagtctgcctccatccttgaatgcctgtacctgaatatcaggattactgctggttatatcaacacgttcgccttttacattcttccagagttcgaagaaatattttttgtcattaagcctccatgtggtattcttcagattctgaggattgtcgggaataaacagtgccgcactatatgaagtataattgtttgcagcggtgatatgccactcagccttatctgagacaaaaggtattgagataaacaaattgtcctgacgttccatcagattaaacagaaaatgattaaacgacgaaacactccgcacactgcttatgtcatcatagctgtcgtcgggcttgctgttgtcaatacctccaaactcggaaatggcaagaggcttgacatgtccgaacttaatataggaatacgcctcaaccatatcaagaactgcttcggagttacttcctgaacgtttcgtatcggtgccggttacatttattccatcataaagatgtacagagaatccatccatatatgcacctgcccgatcgatgaacattttcatgcgggtgttccagtaattgaagttcccatcctcccaggcggggtaggctgcggcatagcctatcaccttcatctttccgttaagacgcggattattgtgtatatgtttacctattgaagcataaaaatcgaccatcagttcgcgcatagcctgtccctgaacggtaaaaccggcatcatttgcatgaacgaacggttcattgaggggttcaaaaaactcaggtaccagctcgctgttggaataatactcagccgaccatgcacctgcagcctgaacgtctatgccgccctgtatgtgctgtacatagggatgctctgtggcaatatatctttttacggaaatatttccgctgtatggtttcatctgaggatatttgcctacctcatgcgtcttgttatacgcatacgagtatggtccccagaactttcttccaagaccgacctgatagtcggcaagaaacttgcctacatccttatcatcatcggaggtggaatgaatattgaaatatttagaacggtcgagttctgaaacaccgctcaaaaagcgacgggtattatagtcgacaaccacctcgttcctttcctgacaataaataccgggaggaacacctagggtaaatgccgataacagaaaaatatatttatagctcataatttctttccttttagacacagaaacttgtcagtcctgatgtggatacattattttctcactttcttatcgtagcgttcagtctgaagaatcatagtagccacacggcctccattatccgggaatgttactgacaccgaattttttccttttctgattaaccggtagtcgaaaggtatttctatcataccgaagaaatcgtctctgccggtctggtcatatcctctccaattgtcgggcatgtcgactttcttgccattaaccattatttcaggtttcttcgacatctcgtgcttcctgcctattgacatacgcagaacagctcttcctgtacccggtttcagaccatcgaaatcaaacacaattggttttccggcttccaccggctgaagataagtgttgctataatatttagtacgaactattctgtttgaatactttttacggatgatgtcggcacacaatattattgtctcatcttttataatgtcaatactttgaggcatcgagttcagcgtcttttcatcataaactatacctttatcgaaaatcatcttcaaagagcgcacagaaacattatctacacccttccaattcagtacgtttttcaagtttaccttatgtgtatagtcatcaagattgtcgacagctatgtaaagcctgtcatcgtccttaaaagctgccacctgtatgtccggattgtcggaaacaatatctacacgttcgcctttcacatccttccataacttgaagaaatatttcttgtcgttcagtttccatgcggtattcttcaagtcgtgaggattgttggcaacaaataaagcagctccgtatggttcgaaattatattgtttcgttatatgccattcggccttgtcagaaacaaagggtattgagatgagcatcttgtcttcgcgttcaagaagattgaacagtatatgattgaacgaagcgacagttcgtacagaggctatcggattatatcctttggaagtgttgtctattcctccatattcggttacggcaagaggaagaactttccccaagcggatgaacgagtagttttccataaggtcgagaatagcttcggaattacttcccgaacggcgggaactcttgcctactatgtttattccatcgtaaagatgtaccgacaagccatccatgtactccccggcacggtcaatgaacatcttcatagtattattccaatggtcgaaatcgcgcaactccatagccggatatgccgcggcatatccaatgattttcatttttttcagacttggctcagcgtgaatatgctttcctgtctgtgcataaaaatctgccatgagcatcctcatttcctgaccatgcatattgaaacatttgtcgcgtgcatggacaaagggttcgttaatgggttcgaaaaattcaggaactgcccctttcacatgcttggaatagtattcggcagcccatgcacccgccttcactgggtctatgccccattgtatggtacgcgcgttggcatgttccgtagcgacatatcgttttgtttccttcaaatcagtgtagttcaaaggcttttctgaaaaaggatattcgccaaccttttttgtcttgccatatgaataagagaacggtccccagaaagagcggccgattcctacaccgtaatctgcaagaaatttcctgacatctggatcagaatctttagatgtgtgtatattgaaatatttacctctgtcaagtgccgatacatcattcaggtatctctgagtggcataatccactgtgacagtagtgttataagtcttattctcggaagatgataaaggaaaaaccgagaaagacaaacacacagacaaagctgtaagaattatgttattcattgtattatcaaaatttaaaaggcagagaacactccgatagttcaattaaagtattccctgccattaagattatcacttctgtttaaacactaatatcagaaatcggccggtttgagtacatcgttcagcaccacttcatattcaacttctgttccgtcgttttcagtaacagtaagatggccgtaaccgccacttgagttattttctttcttaccttcaaacatgaacattctcttcttcgtcacttcctgttcttctttatcgcctgtttcaggattgataacttcttccttttcagtatagacttcattgaaagagaatgagagatgtttttctgtatccgaattgattttcagccactcgggcaattccgaaggagcctcagacgactcggcaaagaactcgatcttattcattctcaaagtctgatagtcattcttccaggcaatgaggtcgaacaattcgcgataaacagaaaacttggaaacctcgcctgtctttcctgtttccacattcttgagataggtaagttcatacacgggagtagaatcaagttcgacctcagcccatttgtcattatcacatgctccgaacaaaaccaaagcacataagaatgtaattgtcttataaattttatctattagcttcattgttactataatttattatggtcttacttcaatatatccgaaaaatatatcgtcaaaataaatattatccttaaaggcattaaagcgcatactgagcaatatattgtccatttcagcctttgaagtcacagtggttgtggccgacatccatttgctgtcggagccattcacaatgccgcaccatggtctatcgctctgccatgtcatatcttcagctccttctttacctgccggaacgaaatacggactcatacccttaccctgtttataccccggtgtataatatttgtagctgaaagtatatgtacctttaccaccagtaaatgtcttggagagtaatgccctgcatcggtcaaatgcttcgacaaacatacattttgcactgttgtttattccatccttcagaggattgtccacaacctgtgaaggaactacaggatgtgttttggtatcggcatcaataactttccagtcggcatatgtgtcagaattttcaaaatcttcatccaggaacgcaccaaaagtagtcgctacgtttggagctgtagcctttatctcaaggttctgatatccaaccaacgcttcagttaaagttcctgtaagggtcagttcatctgtgttatagattttctcaaccaaagtaagaatcagttcatatctgctttgcttgtttacttctgctgctgtgatgtttacgctacccctgacagctgacggtctgttatacgagttggagtaagtaagctttagagatgatggatttatctctttatatccaaactcagaattatccaaatctatagcaatgtgtgtttggtcaatctgacggatgttataagtaataggatcatcactaggtactactgtaatagccaaaggcacaacaagagtttttggcgaagcttttggagtgtacttacctttaccctcactggcagaagttctttctattgtcatggaaagaagcaatggcttatcgctgaatttctttgcagtgaactggtatggagtgtcaaaactggttaattcgtcatttacgccagtatccgcacatttgaaagtccatttgttaggcaatccgtatgaatcgtccttaatatagacagacttaccatattcaagttcgtatttttcgtattcgggagcttcctcagttccaccgactattccggtctttatttcctgtgtacactccggatcactgtatacctttacggccggtacgaggttaggatcatacacgcggatatggaaagttgtatccatcacatatacatcaccctcctgcttagcataacaatattttttgatatatcctccggtattgtcgtcatacaccgaatatggatatacaacctgtctgcggaaagtattgcacaaacgtaccgtatggtcaccgggtttagtgaaatacacatgtatggttttcaaatcgttggtatgagggatggattcatcaatcaggtttgtatagtctgtctgtccccactccatcttaccattaaggaactttgtaccatcatccgacacaacccactgatgcgacaacatgccttgggataagtccattatacttatatagttattaagattcagctgaataggtgaaacgttttcctgatctgtactcacatgccaggtacattcagccacgttattcaacggttcaaactcatcatccttacaagatgtcagaaccgagattaatgaaagagcaatatataaaaatctatttttcatcgtatttatttattaatatcaggatttgatgtaatttctatatttggaataggccagtatgccacttgcggaccgtagttcaatgatgcttggaaataatccacaaaagcgtttcctctcttttctggcggcagctcataaaatctgtactgctttccaaagttgaatgctgataccaaagcattagggtcatcaggattaggcttaagatatttggtctgaatcatacagtacttatattcgtcggatgccaactgatcaaacctttccttagttatattccagcgtctcaaatcaatgacacgtatggcatgtccttccatacacagttcaagaggacgttccacatacatcagatgattcattacatcacttgcagcatattccttctcatcgtatgtatatctcttgaattctccctgttccgattttccgataagcacaactccagcacggtgacgtaccttgttgatggcattgatagctgactgaacatttccatcgcttgcaccgcctttaatcagacattctgcatacatcagatatatatctgccaaacggataagacgatagtttattcctgaggccatagcaggcttaaattcagtttcactcttacgtgtatcccaatttgataattttctgaaatacgctgaagagccacggttgaattttgatacctgttgtgggagagactgataatatatcagactttcatcgccgtttattgcaagagaggcagatgcacgcatggaatagcttctgaggcgatatgcctgaccgtcttcccatttaaattccggaactatgtcatcgtagccggtaatcttattgtataaaactttattatctccgacagttgagacgagtcgttcgcgtactccaacatattttcctgctgttgcatcccacgtataaacgtacgttctgttatatacgacaccctgacggtccacctgcgagctgaaagttgttcccaactggtcgtatataatatccctatgttcaggatcaccataattgtcggactgcatttttatccagttacgttcatcaagtctgtccaccggctctgtttcgaatgcttcaacaagccaaaaagcaggaacagtgttaagccaggcatcgcccaagccatttacattcattccccatatattatataaggtagactccgaccatgtaccgaattctgtattatactgtgtagaataggaaacctcgagaatagattccgaattgaattcattggcagcagtaaaattatcgactatgtcatcaaccaaagcaaaacctccattatcaataatatccttaaaatattcggcagctttattatactctttatcataaaggtagcttttgcctaatattgcctttacagcccaagaggtgatacgtcccaaatcggttttctcccatttgtcattcaagccaaggtcaagagctttctgtaaatcttctctgtaatatttcttgatttcatcacttggtgtaacctttttatagtaatcttcttctacctctgcaatttcattaatataaggaacattaccattattgaatgaattattgagataaaaataaaacaagccacgcaaagaatatgcctgtgcctcaatctgagcaagcttggttatttgaggttcatctgtaacatttggacggattttctctatactggccagaacctgattcgcacggaacacaccagtatacagtgcagaccatttaccacggactgttccgtatgaatcattaaaggtttgcttataggcttcgttatcaaactgctttctgtccttattaccttcaactgctatatcacttctacggttctcatcgagcggatgataaatattggtatttttcaaagcattatatacagcagccagtcctttctcgcagtcgcctattgttttataaaaattctgtgttgtcagctgatgtatgttttcctgcgtaaggaaatcgtcgcatgaaaccaatgtcatgcccgacatcaacagactgaatactattgttttatatctgaagttcatatatttatattattaaaagttagaaattaatctggaatccgccacgcatctggatacttataggatatgttccatagtccaaaccacgacgtgacaatccattactaccgacctcagggtcgtatccgtcgtattttgtcagtgtaagaagattatcggctgcaacgtataaacggaacttgcccaatccaagctttgatacccaactcttggggaatgaatatcctaacataatatttttaagtctgacaaatgaaccgtcctcaatccacatatcagtatgagcacgatagttgttatgcccctctgtacgataagaaggaatggtagaggtatagttggtaggggtccacatgtatatcagttccttattggttcttctttgatatgtatatatcttcgtaccgtttattatttcatttccaactgaagcataccagttcatagagaaatcgaagcctctatagtcggccgagaagttcaaaccaagttcataatccggcataccactaccggcataaacacggtcgtcatcattaagaacaccatcattattggtatcgatatacataaggtcacccatacgggcacttgactgtaatttctgatattctgcaagcttctgttcagtattgattacccctgcggttggcataacaaagaaagcaccggcttcatatcctttcttgattgcagttacataatcacttcctgatgaaacaggtttaccgtcggggaagaaatataactcattttttcctgccatagacacaatctcattcacgtttttggtaaatgtaccagtcaagctgtaattaacaccacgtattttgttgcggtgagtaagtgaaaactcaacaccacggttttccatatctccggcattcaatgtaacagttgaactctggccccctccatttgacggtggcacgaccatcgggaaaagcatattcttcttgttactcttgtacaaatcaagacctaagataagcttgttattatataaagccatgtcgataccggcattaagctgctgggttgtttcccatttcacattcggattggcaaatcccaattgggtaaaaccatttgcaagaatttcggaagttccggtaccaaaagtatagtcgtagtttttgtatatagctggtgcgtatgaataatcagggaagttctgattaccggtagtaccatagctgaatcttaattttaacgaatttactagccacctgaatctgtcgaagaatgattcctcagaaatattccatcctacagacaatgacgggaacaatccccaacgattttcttcggagaacttagatgaaccgtcgcgcctgatactggcacttgccatgtatttgtctgcatagctatattgtagacgacccaacataccaaccattgtactgatacggtcctgtccccactggccactgcctgtacccacagtcatatcggatgttcccgcatttaggttcggaatctcgttagtaaccaaatccattatactggcatagaacatctcgtatgtatatttctccatactgaaaactccggtaaatttaatatcatgcttttttatcttcttattataatttaccattgtttcccaagtgagactggtattctttgaatgagtatcttttaattgcgaacggtaattagagctggttaccttttcgcctttctgattatatacctcaaactcaggtcgaattgagacagctttctgattgttatatccaaagcccaaacgtgtggaaacattcagtccgggaattacattataagcaagataaaaattaccgttaaatgattctgtgtccttatgattttcctctttcaatcttcccaatgtataacttacgccctgtaaatctgcaggatcgccagctgcatttactatacttgcctgtggataaatctgagaacgagtaggcgagtagtcataacattcgttcaataacccccaagccggagataactggttttctatcttcatagcgatgttagtgttgatagtccattttccgcgctgaaaatgtgtattcgaacgaatattatatcttttgtaatcggaatttatcaacacacctttctggtcgaaatagttcgcggtaaggttatatgtcaaatctttcttgccgccattcgcagtaacagaataattctgtattggtgcgttattattgactacatattcatataaactagagttgttgaagaaattcacaggatatgttttcagattagaccaggccaggtcgtctgtattctggtttccttccatcattctgttagacatcacttttacaaatatactctcgttggcatcaagcaaatgaatattcgaagtaatgtgctgtacaccataatatccgtcgacagctatcttcatttctccttccttacccttctttgtggtaataaggataacaccggaagcaccgcgagtaccataaatggcagccgaagcagcatccttaagaatatctatacttgctatttcgctactactcaatcccgggtcgccctcgaacgggacaccatcgacaacatataaaggagaactgtcgcctgagatagaacttaaaccacgaatctggatgttggatttggctccaggctcaccagaacttgcctgaacgttaactccggcaaccataccctgaagagctgtacccaagtcggaagtactgatcttagtaatctcatctgagtttacacgtgccactgcacctgtcacctcttttttacgcattgagccataacctacaacaaccacttcatccaacacttttgtgtcttcctgaagcttgatattataaatctgaccattcttgattgcagcttttacagttttatacccaacaaaactgaacactaagttacctttagtcggtaccccttgaagaacgaaattaccatccatatcagtaatagttccaagagaagtaccttcaacttgaacagctgcgcctataacttcaaggttattggcagcatcaatcacctttcctttaactgttatcttctgtgaatacatagacaatgtatagaagataagcatcacgaacaacatgtacctgccatggtaccattttttctgatttctcatttgtaaaaattttaatttagcaataggttatgaaattccttttataactgacgctaaattatttatttataatggtacaaaaggggagaattatatatttaaaaagggggtaaaattttacccccacttatattaagaatccaaatcggtctgtatactctgttctttgtactgttgcggcaatacaccgaattctttcttgaaacattctctgaaatacttcaaatcattgaaccctacatcgtatgtcacctctgatacagaataccgtcctgtcttcaacagttctgccgctctcttcattcttattgaacgtacaaaagcattggctgttactcccataagtgctttcagcttcttgttcagaaccaaggccgtcacgccaagacctttacatatatcctctatctggaacgaagagtctgtaatgttgtcctctattatctttacaagtttctcaaggaacttatcgtcggtagatgtagtgcttacctcggaaatctttattgccggaactttcttgtgttgaagaatccgcttcctgttggttataatggaattaagcagctctttcattatcttgttgtcgaaaggtttagggcaataagcatctgcatggaatttatatccgatgaaataatcctgcaatgtagtcttggctgaaagcaatactacaggaatatgagatgtccttacatcctgcttgattctctcacacagttccagaccattcatgcccggcatcattatatcggataaaacaagatccggttgcaaatctggaatcatgttccatgccatctccccatcatgggctatcattatcttatacttatccgacaacagtaatgacaacatattacatatatccttattgtcatcaacaatcaatatagccggagattctccgtccacttctatgtctatcatctcttcatgctcgcacgattcacttcttaacacatcagcaaacttttcatcctccccactgttggcagagatattctccgtaaccatgtccccctcagttatcataggaattacaacatggaaaacagtgcctttaccttcctctgatacaaacgtaatatttccattatgtatctctacaagccgcttggtcagaaacagacctataccggtacctccttcagcagagtttttattctgactgtagaaacgctcgaagaggtgtgttttcaggttgtcggatattccgtttcccgagtctgccacagagatgtttattttgttatcctgttcattgacagtaaacgatacaaatcctccggcaggagtatgcttaatggcattcgatacgagattatagattatctgttccataagatgagggtcgaacagaaagcttatatcactgcgtgagacagaatattccagccctacacctttctgttttgcccaatacgtgaactgctgaaatacttcttttgagaaagacgagaagttgccatatttgagattcagactaagcattcctttctcgctctttgagaagttcatcagctggttgacaagacttaacaggaacttactgttatgctccattgtctgcagcatgccggcaagatacttgtcggacgaatacttgcccgattcaataatcatactaagtggagaatgaataagtgtgagtggtgtcctcaattcatgcgatatgttggtaaaaaatgtagtctccttttcaagaagttcttcagtcttgcgtttttccatgtttgctatatatagagcatttctgcgctgcacccgtgaggtataatacaccttgaaccggtataaagacaagacaagcaatataaaatagagtgtataggcataccatgtacgccagaaaggagggttaataatgacaggtatggaaagttcattcaaactgtagactccatcgctattcctgaccctcagtctgaacatatattcgcctgaaggaagctttgtgtagaaagcctcacgatgaaaagcggaggtggaaatccatgaatcatctacgccttcgagcatatattcgtaaccaaccttataaggacttctgtaatccagggagctgaactggaatgagaaagtgtttaaattataaggcaattcaatgtgctctgtaaaacttacacttttgtcgaaataagctgaatatgtggaatctgcctcaacgctgtgattgaagattttaaaatcaacgagtgtaggactaccgttgaaatctatcacatcaaagtcattaggtctaaagacgttaattccgtttacgccaccgaatatcattgttccatccgtcattactccagcagaaagttccataaattcataatcctgaagaccatcgaaaatatcataagatcttattctctgtgtgttgatattcaacgaattaattcctttattggtagaaatccataatgttccatccgtgccattaacaattgattttattgtattgctgctcaacccgtctgcagagctaaaattttcaacgcaggcattatggttttcatccaaatccacgattttccttaacccacgtccaagtgttccataccagatattatgattcaagtcttcacatacaggcactatatagtcgagttcatcaagtcccttgactgagttcaaaacaggattatctatatacaaatctgcagattccaatactttaagaccgaagctggaagctacccatatattacccttatgatctttaatgatgtttcttactatcttaagttctttattgtcagatgttttgatttccttcatcacacctgtggacaaatcatatctgaaaagacctttattatatgtgccaatccacaaatattttccatcggcaagcattgcgcgcacatttctcaaacctgagatctttttataatcattatcagaagtgaaactgtaaataccatcgtacatcagagacacatacatgcagtcggtgtagtttgagtatgctgttgagtatactatcctgtttgccgtgaaaggaataagtctggcattaccggtaatggaattaaaatgatatagccctgagccttctgtgcctaaatatatatcagatttggcaaatgtataaacggacgatatatgatcatttcctattcctctgaataaatctataggtttattattttcgcgtatactcataaagccactcttgaaaaatcctatccaaagaatatcgtttttatcaagaactacagtttgcggatagctgtaagaatatgtagcaataacctgtggttttgactcgatggcatgcaatacatcaaaagtcaacacattcacagtgcttgtagtggcataaaataatcttttgtttttatataccatttttcgtatatcacagttttccaacagggtacttaccttgcaggtatgcttgtcgtataaacataattgatgattttccagatttgagtacaatatttgagaagatgagatgactatggctgaagctatagggcatcccaatagtttgttaagcagtaattcatctccatcgacgttacattcgtacaggccgtcttcggaggagagcattatcgtattatctatttctatgatgtcggaaatgtatggtaattttaatgttgatcttaagacagtatttattttgccattttgaaaatcataatttacaaggtatatactttcatcagaggaatgaaaccagactctgtctttagagtcgacaagaatcttatcgcaagtgaaatttttatcaataccgctgtgaccaagatttaatgaaacgaattcgttctttacagaattgaacaggaacactcctctatcggctgtacctatccacagatttccatgtgaatcttcgtcaatacatactatcagattactgttaagaccgtttgactgatatccgtaaaccttaaattcatatccgtcaaacctgttcagtccgtcgttcgtggccaaccatataaagccttttgagtcttgataaatacattgcacatcattttgggaaagtccatcaagagtagtgtactttcttgtgacaaactcattggatgcaaaggatttgcaaactataatcagaactgatattaaacttaagattaatctaaacatataactattattctttatatttcatcaagattacaaagttattgattttatctaaaacatcaagtatttacagtagttaatagataattatagatattttccactttagaatgcgtatcaaaatcaatcaagaaaaaaataaatctttaacttcatttcatagtataaaacaaaaaaagcatcgtaccattacactcaataatagatacgatgcccgaaagaaattacagtaacagactgtattgggatt

SEQ ID NO: 63 - DNA, 53695 bp, Artificial Sequence
  Synthetic sequence
aacaaatactttcaggacgatgtaaagtcctgagaaatcaaactgaatggatagataaatattagtcttttctcatcggattcttttaatatcgctactcttttattatgtagtggttgtattatcttaaataaaacaaaaacacccgactttacattcttgggtgtaaaacagggtgtttgttttgcaatctgctgattttcagcgttttttgcggagagacaggctctcgaacttatactttcacagaatatcataaaactgcaaacgactgataatcaagtgtaaattacaatatagagtaaaagtaaatgtttctaaatgtcttttgctatctcaataattgggtgtatatttgggtgtagaatttcaaacgcacccaattatgaatatcaagcgcaacatcatttttgcattggagagccggaaaaagaacggtgtgccaatcgtagagaacgtacccatccgtatgcgtgtcatctttgccagccaacgtatcgagtttacaacgggctaccggattgacgtagccaaatgggatgcagataagcagcgggtaaagaacggatgtaccaacaagctaaagcaaagtgcagccgaaatcaatacggacttgctgaaatactatgccgaaatccagaatattttcaaggaatttgaggtgcaggaggtcatgccaacgacccaacagttgaaggaagctttcaacatgagaatgaaagataccagtgaagaacagccggaagaagcccctgtcagcttttgggaggtgttcgatgagtttgtaaaagagtgcggtaaccagaataactggacggcatccacctatgaaaaatttgcagcagtgaggaaccacctcaaagagttcaaggaggatgcaacgttcaactatttcaacgagtttggattgaacgaatacgtcaacttcctgcgtgacaccaaggatatgagaaacagcaccatcggcaagcaaatgggattcctcaaatggttcctgcgctggagcttcaagaaaggacatcatcagaacattgcatacgatacgttcaaaccgaaactgaaaaccacctcgaaaaaagtaatcttcctgacttgggatgaactgaacaagctgaaagactaccagatacccaaggataagcaatacctggaacgtgtgcgtgatgttttcctgttctgctgctttacgagtttgcggtattcggatgttcgcaatctgaaaagaagcgatgtgaagtccgaccacatcgaaataaccacagtcaagactgccgacagcctgacgattgaactgaacaaatacagcaaagccatactggacaaatacaaggacatccatttcgagaattacatggctctgcccgtcatcagcaaccagaagatgaacgattacctgaaagagctgggcgaactggcagaaatcaacgagcctgtacgggaaacctactacaagggaaatgaacgtattgatgaagtcacacccaaatacgctttgctcagtacccatgcaggaaaaaggacattcatctgcaatgcgctggctctcggaatcccggcacaggtggtcatgaaatggacgggacacagcgactacaaagctatgaaaccctacattgacatagcggatgatattaaggcaaatgccatgaacaagtttaatcaactataaaagtatcaaacagtttcatagatagttaccaatgactgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaacggaattgatccggccacgatgcgtccggcgtagaggatctgaagatcagcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctagctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgccagaagagagaaagaaggaaagcggccgcacaggtttcccgactggaaagcgggcagtgagcgcaacgcaattaatgtgagttagctcactcattaggcaccccaggctttacactttatgcttccggctcgtatgttgtgtggaattgtgagcggacaacaatttcacacaggaaacagctatgaccatgattacgccaagctatttaggtgagactatagaatactcaagcttgcatgcgatacgtatcgttaacgatggatccgacgcacgtgcgaattcgccctatagtgagtcgtattacaattcactggccgtcgttttacaacgtcgtgactgggaaaaccctggcgtcacccaacttaatcgccttgcagcacatccccctttcgccagctggcgtaatagcgaagaggcccgcaccgatcgcccttcccaacagttgcgcagctgaatggcgaatggcgcctgatgcggtattttctccttacggcggccgcttgacataacttcgtatagcatacattatacgaagttatgtttaaacattagcagaaagtcaaaggcctccggtcggaggcttttgactaaaacttcccttggggttatcattgggtcgagaccgcctgaagaggacttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaagcaacttcagacaatacaaatcagcgacactgaatacggggcaacctcatgtcgcctgaagagtgagaccgtcccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaaaatgtaatcacctggctcaccttcgggtgggcctttcacacttgcatcggatgcagcccggtgaacgtgccggcacggcctgggtaaccaggtattttgtccacataaccgtgcgcaaaatgttgtggataagcaggacacagcagcaatccacagcaggcatacaaccgcacaccgaggttactccgttctacaggttacgacgacatgtcaatacttgcccttgacaggcattgatggaatcgtagtctcacgctgatagtctgatcgacaatacaagtgggaccgtggtcccagaccgataatcagaccgacaacacgagtgggatcgtggtcccagactaataatcagaccgacgatacgagtgggaccgtggtcccagactaataatcagaccgacgatacgagtgggaccgtggttccagactaataatcagaccgacgatacgagtgggaccgtggtcccagactaataatcagaccgacgatacgagtgggaccatggtcccagactaataatcagaccgacgatacgagtgggaccgtggtcccagtctgattatcagaccgacgatacgagtggtaccgtggtcccagactaataatcagaccgacgatacgagtgggaccgtggtcccagactaataatcagaccgacgatacgagtgggaccgtggtcccagtctgattatcagaccgacgatacaagtggaacagtgggcccagagagaatattcaggccagttatgctttctggcctgtaacaaaggacattaagtaaagacagataaacgtagactaaaacgtggtcgcatcagggtgctggcttttcaagttccttaagaatggcctcaattttctctatacactcagttggaacacgagacctgtccaggttaagcaccattttatcgcccttatacaatactgtcgctccaggagcaaactgatgtcgtgagcttaaactagttcttgatgcagatgacgttttaagcacagaagttaaaagagtgataacttcttcaacttcaaatatcaccccagcttttttctgctcatgaaggttagatgcctgctgcttaagtaattcctctttatctgtaaaggctttttgaagtgcatcacctgaccgggcagatagttcaccggggtgagaaaaaagagcgacaactgatttaggcaatttggcggtgttgatacagcgggtaataatcttacgtgaaatattttccgcatcagccagcgcagaaatatttccagcaaattcattctgcaatcggcttgcataacgctgaccacgttcataagcacttgttgggcgataatcgttacccaatctggataatgcagccatctgctcatcatccagctcgccaaccagaacacgataatcactttcggtaagtgcagcagctttacgacggcgactcccatcggcaatttctatgacaccagatactcttcgaccgaacgccggtgtctgttgaccagtcagtagaaaagaagggatgagatcatccagtgcgtcctcagtaagcagctcctggtcacgttcattacctgaccatacccgagaggtcttctcaacactatcaccccggagcacttcaagagtaaacttcacatcccgaccacatacaggcaaagtaatggcattaccgcgagccattactcctacgcgcgcaattaacgaatccaccatcggggcagctggtgtcgataacgaagtatcttcaaccggttgagtattgagcgtatgttttggaataacaggcgcacgcttcattatctaatctcccagcgtggtttaatcagacgatcgaaaatttcattgcagacaggttcccaaatagaaagagcatttctccaggcaccagttgaagagcgttgatcaatggcctgttcaaaaacagttctcatccggatctgacctttaccaacttcatccgtttcacgtacaacattttttagaaccatgcttccccaggcatcccgaatttgctcctccatccacggggactgagagccattactattgctgtatttggtaagcaaaatacgtacatcaggctcgaaccctttaagatcaacgttcttgagcagatcacgaagcatatcgaaaaactgcagtgcggaggtgtagtcaaacaactcagcaggcgtgggaacaatcagcacatcagcagcacatacgacattaatcgtgccgatacccaggttaggcgcgctgtcaataactatgacatcatagtcatgagcaacagtttcaatggccagtcggagcatcaggtgtggatcggtgggcagtttaccttcatcaaatttgcccattaactcagtttcaatacggtgcagagccagacaggaaggaataatgtcaagccccggccagcaagtgggctttattgcataagtgacatcgtccttttccccaagatagaaaggcaggagagtgtcttctgcatgaatatgaagatctggtacccatccgtgatacattgaggctgttccctgggggtcgttaccttccacgagcaaaacacgtagccccttcagagccagatcctgagcaagatgaacagaaactgaggttttgtaaacgccacctttatgggcagcaaccccgatcaccggtggaaatacctcttcagcacgtcgcaatcgcgtaccaaacacatcacgcatatgattaatttgttcaattgtataaccaacacgttgctcaacccgtcctcgaatttccatatccgggtgcggtagtcgccctgctttctcggcatctctgatagcctgagaagaaaccccaactaaatccgctgcttcacctattctccagcgccgggttattttcctcgcttccgggctgtcatcattaaactgtgcaatggcgatagccttcgtcatttcatgaccagcgtttatgcactggttaagtgtttccatgagtttcattctgaacatcctttaatcattgctttgcgtttttttattaaatcttgcaatttactgcaaagcaacgacaaaatcgcaaagtcatcaaaaaaccgcaaagttgtttaaaataagagcaacactacaaaaggagataagaagagcacatacctcagtcacttattatcactagcgctcgccgcagccgtgtaatcgagcatagcgagcgaactggcgaggaagcaaagaagaactgttctgtcagatagctcttacgctcagcgcaagaagaaatatccaccgtgggaaaaactccaggtagaggtacacacgcggatagccaattcagagtaataaactgtgataatcaaccctcatcaatgatgacgaactaacccccgatatcaagtcacatgacgaagggaaagagaaggaaatcaactgtgacaaactgccctcaaatttggcttccttaaaaattacagttcaaaaagtatgagaaaatccatgcaggctgaaggaaacagcaaaactgtgacaaattgccctcagtaggtcagaacaaatgtgacgaaccaccctcaaatctgtgacagataaccctcagactatcctgtcgtcatggaagtgatatcgcggaaggaaaatacgatatgagtcgtctggcggcctttctttttctcaatgtatgagaggcgcattggagttctgctgttgatctcattaacacagacctgcaggaagcggcggcggaagtcaggcatacgctggtaactttgaggcagctggtaacgctctatgatccagtcgattttcagagagacgatgcctgagccatccggcttacgatactgacacagggattcgtataaacgcatggcatacggattggtgatttcttttgtttcactaagccgaaactgcgtaaaccggttctgtaacccgataaagaagggaatgagatatgggttgatatgtacactgtaaagccctctggatggactgtgcgcacgtttgataaaccaaggaaaagattcatagcctttttcatcgccggcatcctcttcagggcgataaaaaaccacttccttccccgcgaaactcttcaatgcctgccgtatatccttactggcttccgcagaggtcaatccgaatatttcagcatatttagcaacatggatctcgcagataccgtcatgttcctgtagggtgccatcagattttctgatctggtcaacgaacagatacagcatacgtttttgatcccgggagagactatatgccgcctcagtgaggtcgtttgactggacgattcgcgggctatttttacgtttcttgtgattgataaccgctgtttccgccatgacagatccatgtgaagtgtgacaagtttttagattgtcacactaaataaaaaagagtcaataagcagggataactttgtgaaaaaacagcttcttctgagggcaatttgccacagggttaagggcaatttgtcacagacaggactgtcatttgagggtgatttgtcacactgaaagggcaatttgtcacaacaccttctctagaaccagcatggataaaggccaacaaggcgctctaaaaaagaagatctaaaaactataaaaaaaaaataattataaaaatatccccgtggataagtggataaccccaagggaagttttttcaggcatcgtgtgtaagcagaatatataagtgctgttccctggtgcttcctcgctcactcgaccgggagggttcgagaaggggggtaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggtcggccgcggtgtctcgcacacggcttcgacggcgtttctggcgcgtttgcagggccatagacggccgccagcccagcggcgagggcaatcagcccggtgagcgtcggaaaaggaatattcagcaatttgcccgtgccgaagaaaggcccacccgtgaaggtgagccagtgagttgattgctacgtaaataacttcgtatagcatacattatacgaagttatggactaggtaaacctccccgatgggtcggaaaccgacaaatcggacgagagaatcagtccgtcggccacttcaatgccacgccatagaatcatgttctgtagagtagtactgaaatgaagctgagcctgaacatttgctgacaaaaatataaatacaggaattaacagtcgctttttatacttacaggtatccaatgataatatatgtatcatactcagagcagtagaaaatcggttttaaattattattatggatttatttgtcgaaatactctataagattataaacattccagttaatatccgacatgtatttggtcaatgatgtataaggtttatagttataatcgagcatacctttattgcaatcctcatcatccagatacttgaagaaaacccatcctacacaattcttggcttcgagcagtcccaaggtaaaatgctggtaagcgaatccacggttttgctggtcgcgtaccacgaaaccagctccacttgaattgtcaagcttagtatcctcacccttggtatagaattccgttaccatgaaaggagtaccgcccgcctggttcttccagccatccatgtagcctttttcaggcgaccatttactataataatttatggaaatgacatcacaatattttcccgctgccttaattatataactgttgtatttaggaaggctgtgcaggcgtgaacccagataaagcaattcaggatccttcgatgccttaaccgcattctttatggcagaataatatttttccgcacaaataccggcaaactcattgttcagttcatccgttacatcagaaacatttgcactcttgtccttatccgtcataaacttggcggctgcaatataagcaggatcctgcttgtttgaaattttcaggaatctgtcgagcagcctgtttccccatgtagagaagtctatctcattatccgagaagaatcccaacacatccgggttgtttctgaacatgccgaaagcatccgaattgagatactccttgcaccattcatcccatccatcataaaacacaagacctatcttaagattcacgttctgccccggatagctaattcccttgctattcttgaactctgcaaggaatgaaaaggaaggagcctgtgtcagaggacttgaagccgatttattataatcatttacagccttgtcgccttcttccttaccgaaagcgcagacactatgaaatcctatttcagagaattgtttctgcgactttgccacccagtcatctactgaactgtaaagcttgccgaaagctgagctgttgccatccattctgaatgaggcgataccccttacataatatggataaccttcggggtcgactatccaacttcttccatttgagtttttctcaaccctgaaccgtccagtagccttggatttttgcccttttgcgtatgagccatatttattcacgctttgcaaatactcatcctgtgtttttgtctgctgttcataaccaaccaggtatggcaatatccttgtctttgcctctataaaagccttgtcaggtttttccgcatactcgacaattatcggttgatactgcttggtgctattaggataggtttcagcaggaccgggaacaggcagttgcagttctacatcatcatcgtcattatcgcctgcattgtcgccgggagtattatagtcctccacattccccggttgtgagtaaataacctcaggcggaatatatgagaactcctcctgagggtcttcacatgacaaagcgaagaacggaacactcaagcaaatggttttagtaataatagtagaatatttcattgttgcaaatatttagtaaattaatataaatcccatgtcctgattgtatccccccatcggtggtctatcgggaactccatttctccccatgccttaacagaagtccaaggttggtcggcatcagtccagaatgggtcagaggcaggcaatcccaacggaaggaatgcaagtgtagtcatatacaggctgccattgtttgtataatgattcgaaatgccagtctgatgtccgcagaatcctatggtgaggaatccgccctcattgaagttattgcccgacttgaacatacgtttcatacacgctgtcagcgcacatctcacctgtgctttcgatactcccgccggcaactcattataccatgctataagagccagtggctgcattgttgccatacggtaaggtatagagcgtccgaaaacagggaatgttccttcaggagatatgaaacgctccagaatcatggcgaacctctgtgccctcatcaatgccctgtcatagtacttgcgatagtcgaaacgtgtcctcacgcccgattccattattgcatgtatagattcgagatacataggatggaacacataactgctataataatcgaatgcaaagtgctgtccgtctgcgtaccatccgtcgcctacataccattcctccaccttgcggaaagtagaatttatacgatatgtatcctgtccggcatcaattttggcaaggaagctttcaatggtggccgagaacagcagccagttagtgtaaggagggtcaatgcgtcggagacctttgaactcttttatgtagcgttcctttgttgtctggtccagcggtttccacagctggtcgaacgcgcgcaggaaactttccgcaatataggcagcatcaaccagtgcctgaccatgaccgttccacaacagataatccggactattagggtccaccgcatttgcataactcttcaatgcccattctttcagttgcttgcgctgctgtccttctgctgtatcatcgtcaggcaggctcaaccatggagctataccggccatgagacgtccgaaagtttccatatatgcaaccttcttgttacggttatcccagtttggacttacctcaagaatcatatttttctgcagttcccctttcgccatattgctcaacacaggagcagccatcctgtaagccatatccgtccagtattttcttgtctcgttgttgtttgcctcgagataacgcacatactcgcaagcggcaagaaggaatgcgcctaccccaaagttggcagtcgacttggcgtcaaccacctgtcccggaatagccttttcaccgattggctggacataacccaccgaccagtctttctgcagtgcagtcttggtaagatatttccatgctttccccactacaggcataaattcatccttgtcaagataaccgttgtttatcccccaaagcataccgtaagtgaagaaagcggtaccgcttgtttccggtcccggagcatgttccggatccatcatacttcttgtccagtagccctccggctgctgcagacatgcaaccgcctttgccatacgcacaaacttatcctcgaaaaaagacagatgctcataaccctccggcaggtccttcagcacctttgccagagcggcaagcacccatccgtcgcctcttgcccagaaatccttctttccgttcagactcttatgcttgggataaacatattttgcgtcgcgataatagagtccttcctcctcatcatacattattgagtccgacgtacaaagatattcatacagtttcttaagataccggtgattatgcgtaatcttatacatcttcgtcattaccggcatcaccatataaagtccgtcgctccaccaccagtaatccttacgcggtgtgctcatctggtactccatgacttcgcgtgcacgcttgattttataattctccggcatgacgttatacaagtccgcataagtctggaagcacacctgataatcgccgaacagcacataatcatcctttaccccgtatttatacttccattcagatttgttgttgcttttcgcacccatccactggttatactcagcccatgcctccgaatactttctgtattcttctttcccagtaaggaaataggcttccatattaccggtgtgatatgccgcataatcccagaaagaccttgcttcgggggcatgatttttctgccaggcatcgttcactttttcaatcatctccctaacttgctgagcctcagtttttttttgcgaaggaaaatgaaggtaaaacagctataaggatgtataacatccagtagtatctataacagttcatctttgtgatattgtttacattttctaaaacgaaatggggaagaatatatattcctccctcatttcacgaataattgtattattatatttatttgttaggagtccattctgctccgttgttgaaaccttctgttgtagagtcaaaacttgcatctgctcctgtacttggtctttctgtaatttcttcaatcttaaaagaagtgattttagcggttccagtagcatcagtaccaccagggacattagtctgtacagttaaaataacgttctcaagaaccggccacacaagtgaaccatctgctcttgaagctggagtttcagcagaagtagaactactgattgtgaatgtatttgtataggttccacttccggtatttcttccaatccagaatttatatttatcagatgctcccaatctgaatgttgttgcacagtcgttagatgcgtatgtataagtaaatttgtaagtacaaccatcacggaatgacattgatttagtaactgggaattgattatctgctggaacaatttccaattctccacttgcattaattttttcggcaactccttctgcaagatattccttaactgcatctatgttagcgaagttaaaatcaaaagcatctgcatgagtcaaagcaacattggcagattcaatcttgatattagcatcttcgttgttttcgtttttagcagtcaaagcactaacagcataatcagtgttataacttacgctaatatttgcgtcattactataaatcttatcaccaagaataagagtcatagtagttccattcacagaaccggaagcaacaggaattgtttttcctgctactgttatggtaaatgctttgttaacagcatcagtgaatgttccagaaacttccttatcgagtgtaagttcaattcggtcattacctgttgtctgatcaggaacaatttctttagctgaagaaacggcaacagtagtttgtttttccaaatccacaggaggttcaccgcctccttgatcatcattcaatactatcgttacaatctgtcctttagtaactataaggttttcaccactgaagttataagttttagtaccagaatttcttgtaagttctaaagtaaatccatcggtaaatgtcaccggagctacaaccattgagtattccttggcatttttattttgttcattaggaccaacaaatgttccctctttagcggttagagttataacattagaaccggattccactgtcaggtttgctgaagcatcaatttttacgttccctgcaatctttacatcaccaccagcagtaagtttaatacctgtaaggtcagtaagattatttttaaacttaaccaatccacaagtattctggaaagttaaagatttgttattatctgttgcagtagcataagatatatttgcatttgcatcgaatccccaagccggagctgtctgttcagatggcagtgtagtagttacgacaccttcaagacacacagcttcggcattataaggataaagagctgtatatgaattgttaggtgtagccttacctgtaaacgttgtaactgtgctaccacctgtagcggtagtaaacttgttattttcttggcctgaaaagatattgattgcatctcctgttgtccaccacaccgttgttccattctgcaacgaactacggcttgaaggcgtaccggcaacaaaagtcatatcctgaggaccactgactgcatttacattcgacagttcgtcttttgtacaagactggagcattgcaatactcatcaaagccgctccacaaaatagcatcgtatttttcatgacataaattatttgttaaacagtttcaataataaaaaatcacatcacttgttattcatattcttattctttaggatcaggtttccattcagtaccgtcatcttcaaaatcatcatgaccgccatctacaattccgggaggtattgatattcggcataccgcactttttattccattacccgtatctacagaagcaccgatattagaatctctgcccccgtcgattgccacgaccgtacatctcattttatcgtccgatggtgtaatcatcaacacatcagggaaagaagttccccaaactattgacttgtaaccggtataagggagattatccttggttatattaatacccaactccacagtgccactatatggtaattctatataactgacaggtttgttgtcagtctgcccatccttgaacactacatattcaatttttatctcctcagctggtgttccatcacctccacctacgccatcatcatccttatcacacgagattgccgtaaactgtataaaaagaagtatgaaaaggttgtatactgacagaatccgtggttttatatcaaccataataaaatgttatttaagcgccaaacaaaattttcaatattcaaaaggcataagaggaaaccctgaatatgccttattaccatgaaaacaaatcaatctacctttttcaatccggaatcagaaaaatatgttatttatttagaacatatttttccgatttgccagattacaatcacaataaataaatcaacaactaaatctaattacctaatcttataactaaaccctcaaacaatgttatttaaccttttctatcttgacatcatcaagcaggaagcatccaccattacctgaacccggaacagctgtgaaacgatatacaaaaccattttcctgcaatttgaatttaactgttgtaagattgtaattcttacggtctttcttgacctcagcagtggcaatttcttccagtttctttgaatccggattatagtactcaatcctgaagttaggtttgtcaccccaactgtatttggtataagctgaaatctgatattctgctccagtttcatagctgatgtttacagcctgccacataccaaccttcacctcaacagcatagttgcctgaatgtgcctttttcgcatcaactattttgttatctttcttttcccagacattccatgatgtcaagtcacctgactcaaaatcaccgttcttaatttcctgagcgtatgcagaagtcatcatcattccgcaagccatcattgctaaaatttcttttttcattttttctaaggtttttaatttaagtattatgttgtatctattaaaatcactcttctattggaaccaacttataagccctgacccagtcataataagtagtacttttgtccttatccttcaagtcctcagctgtaggtacttgtttttcccaatcgtatgtttcagtaactatatgtatgaacataggtcggtcaaacggagtatctgtatattttgttgtaggcttgatagtgtacatatactttccgtcataatagaatttcacggtatttgcatccacccaccaacaaccgtaagtatggaaatcttctgccgatgggtccgtcatatacgaaaccacatccgaacgtttcgccgtattgtcagtacgtttgcctccttgttcctgataccaatagtgagtattactgttcatctgcatattccatgtcttgttccacggattatcagggttgacacttcttattatacccattgtttctataatatcaagttcctgactgctccatgtctttatcttcttgccgcctttcattatttccttcattaccgggcggttggaaagccaaaaagtagacgacatggtagtgagcgaagccttcatccttgtttcataatacccataatgtgcctggttctttgcagaagcaaccgctccaccggcaagacgatatttatcgcccggctttccatcaagtccttctgttggcgacaaaacggtattgattatacgaagacaacctttcttgacactaacattctctgccttgaaagttgcaggcggccgaccgttagtccaataaggacttttagcatgccatttagcggcattaagacgtttaccattgaattcatcagtataatcttcgttaactacccatttataaccctcaggagcctcaggcaaattttttatatgctcttcagccaaagaatattccttatcattttttaatgtataagatgacaggaataaagatgcagcagataaatacaatactgtttttctcataaactttgtcgttttagattttttgttacacgacaaaagtatataagtttcatgaaagcattaagggggatttacatcgtaaaaggtggggtaaaattctaccactccctgaaacacaattatttcactcatgaaaccatgtgtttttacgatatataaaacccgacagaagaataataccgtattaccggctaatttacataagaataacttttcaaaccgccatataccccactttacgtccgtaccctcagtcctcgactccggcaatatgttttccatatcgagatctatggttttctgcctcggattcaaccactaactgtcgagcatgtggattgcgtatctgtcatagaatctctttccgaaccatattatctcgtctgtgctaagtatgttgttcagacggataatctttccggtattttaccacctacttctcttgcaaatcctgatctgatataaccggatactctcaattcattgatttccgacttgtatacagtctgcgaagaggcattgaaactactgcacagactgaacagcagcaggggaataatttaactgattttaatagtagacattctgtgttcataatatttcattttaatgattacgtttctgactttcgtctgatgcaaaattatgaggtatcggacggggttgtatctttcagtaaaaatcagtaaagtcttggcaaggggtaaaaaacttaacatcttgtatataaatatattacaaacaaggtgcaaagattttcagtaaacgatggcgaatacagaacctatatatttacacgccataaaatgaagaaaaagcagtaggaaaaaaatgcgggcaagttccggataaaatgtgggcaagtttaaggtaaaacttgcccgcattttagatagaatgcgatcgcatttaaaacaagtaaaaaacgaagaaaaaaaatatgtgttcttcacagaacacatatttcaaaaataggtataaacacgctaaacaatgttaacaaaatctatttataaaaaaagctcacatcaataatatctgcaacatttttacaatactccataaatgaagagaccttgggatgatttatacacagagctatctgtgatgtaggcgaaaaacgtcctgtcccgtcaagaaacgctgtaagctcagatgggaggagtatactgccaatacctggatttacgtcagtcagaacgactgtatttacagcttccaccgctgacacatcaagataatcgagtgccggaagatctgcgaagtgcaattttcctatcatattgccgcctttgctgccctgaagagagacactctccaatgaagaacaaccggatatatggatttcactgtcgaatattgaagtttcggaaacatcatcattaagtataacagaaggaacaactaccaattgaagcgaactgttattctccaccctaagtactttcaatgatgatgcggaacttaaatccattcccaaaggtgtatcaatattagagattgaaaatactgaaactcccgaagacggcttgacatacgacatggaataatgcttggacttcactcccgaaatgtctacttttcctctgaaaccgggatttgacaatatatactccacaccctcaaggttagctgtctgcgacaggaaaatgaggtcgttcccttcggttatcctcttcgtgacatcaatctccaacgatgagacaaacaccgacgggaagtttctgtaaagatatgaacggagcaaaggatccggtactcttcggtttactgtatattcagtgtaatttccatcctcgtccgacatcacgacaagacatttgtccgtcatggctttatagaatgcaggtatgacatctgtattccattttgcaaagtaaggaagtttcagatttgtaagacttttacaaagcaccgtagtgccatcggttgaaataagattgagatacgaagttatgccgtcattgccgcgtaaagctaccgattttattccttcgggcaggtcagcaaagtcgaatatagaaaaactgttacactcaagattgacatctgcgagcgaaggaaaactcctcaaaccgctaatagatgtaagttcgcatctactcaagtccaaagaagtggtattgagaacttgattgtcacaaatcagctctccgttttcgctgaaattaaatcctttccgggtcaagacatcgcgtaactttgtatcaaaagtcacttcagacacttcaaagtcggaaatttctgtttcatccttacacgagattattgtgaaacagagaactatcagtacataaaagctaataaaattcctcataacaatcagttttgtggtaataagactatattatcaatccaagccgcgtcgttctgtctttcgcacacaatggcacacactacttttttcactgtagaattaaaatcgaaagatacggctttataattgccgggagaagaaaattcctctgtatataccgttcctgtagacatatcctgtagcatgactttcaacttacatgctccttcggtctttacatcagcagagaagcgataagtcctgccactctccatgtcaaccctctgcatgagtcctgcatgaccagatatacaggctacattattgcctgcattgtcagtctgtacgcaaaccgtaccatagttacccaatggctgccatgctgaaagtccttcgctgaaggttccattctgcaaggtagagacagtatatttctcaacctgcagtatcatggacgatacgtgacctcctccgtcggaaaaggtgatgtcgacattattatcgccattcttcagcagctgtatgtcgaacggtacttctatcataccgaaaaatatattgcggttgctctggccgtagcctttccagttgtcgggaacactcacagcggtaccattaatctttaccaccggtttcttggaagcagagacaggacggcctatcgacatacgcaagcttgctctgcccgaaccggactcgattcctgtgaaggggaacgaaagggatgatccggcggaaatcggtttcagatactcactgctgtaatatttattgcggattatggagttcgtgaatgctgacgaagacacatctgctacaaggactatggtctgatttgggacaattgagatgctttcaggcatggacgggacattctgttccgtatattctatacctgcgttataattgacatatagagaacgctttgtgacattcgatacatccttccagctattcttattgttcagatatacagtctgcgggttatcatcaagattatcaagggcgatatagagtctgcctccatccttgaatgcctgtacctgaatatcaggattactgctggttatatcaacacgttcgccttttacattcttccagagttcgaagaaatattttttgtcattaagcctccatgtggtattcttcagattctgaggattgtcgggaataaacagtgccgcactatatgaagtataattgtttgcagcggtgatatgccactcagccttatctgagacaaaaggtattgagataaacaaattgtcctgacgttccatcagattaaacagaaaatgattaaacgacgaaacactccgcacactgcttatgtcatcatagctgtcgtcgggcttgctgttgtcaatacctccaaactcggaaatggcaagaggcttgacatgtccgaacttaatataggaatacgcctcaaccatatcaagaactgcttcggagttacttcctgaacgtttcgtatcggtgccggttacatttattccatcataaagatgtacagagaatccatccatatatgcacctgcccgatcgatgaacattttcatgcgggtgttccagtaattgaagttcccatcctcccaggcggggtaggctgcggcatagcctatcaccttcatctttccgttaagacgcggattattgtgtatatgtttacctattgaagcataaaaatcgaccatcagttcgcgcatagcctgtccctgaacggtaaaaccggcatcatttgcatgaacgaacggttcattgaggggttcaaaaaactcaggtaccagctcgctgttggaataatactcagccgaccatgcacctgcagcctgaacgtctatgccgccctgtatgtgctgtacatagggatgctctgtggcaatatatctttttacggaaatatttccgctgtatggtttcatctgaggatatttgcctacctcatgcgtcttgttatacgcatacgagtatggtccccagaactttcttccaagaccgacctgatagtcggcaagaaacttgcctacatccttatcatcatcggaggtggaatgaatattgaaatatttagaacggtcgagttctgaaacaccgctcaaaaagcgacgggtattatagtcgacaaccacctcgttcctttcctgacaataaataccgggaggaacacctagggtaaatgccgataacagaaaaatatatttatagctcataatttctttccttttagacacagaaacttgtcagtcctgatgtggatacattattttctcactttcttatcgtagcgttcagtctgaagaatcatagtagccacacggcctccattatccgggaatgttactgacaccgaattttttccttttctgattaaccggtagtcgaaaggtatttctatcataccgaagaaatcgtctctgccggtctggtcatatcctctccaattgtcgggcatgtcgactttcttgccattaaccattatttcaggtttcttcgacatctcgtgcttcctgcctattgacatacgcagaacagctcttcctgtacccggtttcagaccatcgaaatcaaacacaattggttttccggcttccaccggctgaagataagtgttgctataatatttagtacgaactattctgtttgaatactttttacggatgatgtcggcacacaatattattgtctcatcttttataatgtcaatactttgaggcatcgagttcagcgtcttttcatcataaactatacctttatcgaaaatcatcttcaaagagcgcacagaaacattatctacacccttccaattcagtacgtttttcaagtttaccttatgtgtatagtcatcaagattgtcgacagctatgtaaagcctgtcatcgtccttaaaagctgccacctgtatgtccggattgtcggaaacaatatctacacgttcgcctttcacatccttccataacttgaagaaatatttcttgtcgttcagtttccatgcggtattcttcaagtcgtgaggattgttggcaacaaataaagcagctccgtatggttcgaaattatattgtttcgttatatgccattcggccttgtcagaaacaaagggtattgagatgagcatcttgtcttcgcgttcaagaagattgaacagtatatgattgaacgaagcgacagttcgtacagaggctatcggattatatcctttggaagtgttgtctattcctccatattcggttacggcaagaggaagaactttccccaagcggatgaacgagtagttttccataaggtcgagaatagcttcggaattacttcccgaacggcgggaactcttgcctactatgtttattccatcgtaaagatgtaccgacaagccatccatgtactccccggcacggtcaatgaacatcttcatagtattattccaatggtcgaaatcgcgcaactccatagccggatatgccgcggcatatccaatgattttcatttttttcagacttggctcagcgtgaatatgctttcctgtctgtgcataaaaatctgccatgagcatcctcatttcctgaccatgcatattgaaacatttgtcgcgtgcatggacaaagggttcgttaatgggttcgaaaaattcaggaactgcccctttcacatgcttggaatagtattcggcagcccatgcacccgccttcactgggtctatgccccattgtatggtacgcgcgttggcatgttccgtagcgacatatcgttttgtttccttcaaatcagtgtagttcaaaggcttttctgaaaaaggatattcgccaaccttttttgtcttgccatatgaataagagaacggtccccagaaagagcggccgattcctacaccgtaatctgcaagaaatttcctgacatctggatcagaatctttagatgtgtgtatattgaaatatttacctctgtcaagtgccgatacatcattcaggtatctctgagtggcataatccactgtgacagtagtgttataagtcttattctcggaagatgataaaggaaaaaccgagaaagacaaacacacagacaaagctgtaagaattatgttattcattgtattatcaaaatttaaaaggcagagaacactccgatagttcaattaaagtattccctgccattaagattatcacttctgtttaaacactaatatcagaaatcggccggtttgagtacatcgttcagcaccacttcatattcaacttctgttccgtcgttttcagtaacagtaagatggccgtaaccgccacttgagttattttctttcttaccttcaaacatgaacattctcttcttcgtcacttcctgttcttctttatcgcctgtttcaggattgataacttcttccttttcagtatagacttcattgaaagagaatgagagatgtttttctgtatccgaattgattttcagccactcgggcaattccgaaggagcctcagacgactcggcaaagaactcgatcttattcattctcaaagtctgatagtcattcttccaggcaatgaggtcgaacaattcgcgataaacagaaaacttggaaacctcgcctgtctttcctgtttccacattcttgagataggtaagttcatacacgggagtagaatcaagttcgacctcagcccatttgtcattatcacatgctccgaacaaaaccaaagcacataagaatgtaattgtcttataaattttatctattagcttcattgttactataatttattatggtcttacttcaatatatccgaaaaatatatcgtcaaaataaatattatccttaaaggcattaaagcgcatactgagcaatatattgtccatttcagcctttgaagtcacagtggttgtggccgacatccatttgctgtcggagccattcacaatgccgcaccatggtctatcgctctgccatgtcatatcttcagctccttctttacctgccggaacgaaatacggactcatacccttaccctgtttataccccggtgtataatatttgtagctgaaagtatatgtacctttaccaccagtaaatgtcttggagagtaatgccctgcatcggtcaaatgcttcgacaaacatacattttgcactgttgtttattccatccttcagaggattgtccacaacctgtgaaggaactacaggatgtgttttggtatcggcatcaataactttccagtcggcatatgtgtcagaattttcaaaatcttcatccaggaacgcaccaaaagtagtcgctacgtttggagctgtagcctttatctcaaggttctgatatccaaccaacgcttcagttaaagttcctgtaagggtcagttcatctgtgttatagattttctcaaccaaagtaagaatcagttcatatctgctttgcttgtttacttctgctgctgtgatgtttacgctacccctgacagctgacggtctgttatacgagttggagtaagtaagctttagagatgatggatttatctctttatatccaaactcagaattatccaaatctatagcaatgtgtgtttggtcaatctgacggatgttataagtaataggatcatcactaggtactactgtaatagccaaaggcacaacaagagtttttggcgaagcttttggagtgtacttacctttaccctcactggcagaagttctttctattgtcatggaaagaagcaatggcttatcgctgaatttctttgcagtgaactggtatggagtgtcaaaactggttaattcgtcatttacgccagtatccgcacatttgaaagtccatttgttaggcaatccgtatgaatcgtccttaatatagacagacttaccatattcaagttcgtatttttcgtattcgggagcttcctcagttccaccgactattccggtctttatttcctgtgtacactccggatcactgtatacctttacggccggtacgaggttaggatcatacacgcggatatggaaagttgtatccatcacatatacatcaccctcctgcttagcataacaatattttttgatatatcctccggtattgtcgtcatacaccgaatatggatatacaacctgtctgcggaaagtattgcacaaacgtaccgtatggtcaccgggtttagtgaaatacacatgtatggttttcaaatcgttggtatgagggatggattcatcaatcaggtttgtatagtctgtctgtccccactccatcttaccattaaggaactttgtaccatcatccgacacaacccactgatgcgacaacatgccttgggataagtccattatacttatatagttattaagattcagctgaataggtgaaacgttttcctgatctgtactcacatgccaggtacattcagccacgttattcaacggttcaaactcatcatccttacaagatgtcagaaccgagattaatgaaagagcaatatataaaaatctatttttcatcgtatttatttattaatatcaggatttgatgtaatttctatatttggaataggccagtatgccacttgcggaccgtagttcaatgatgcttggaaataatccacaaaagcgtttcctctcttttctggcggcagctcataaaatctgtactgctttccaaagttgaatgctgataccaaagcattagggtcatcaggattaggcttaagatatttggtctgaatcatacagtacttatattcgtcggatgccaactgatcaaacctttccttagttatattccagcgtctcaaatcaatgacacgtatggcatgtccttccatacacagttcaagaggacgttccacatacatcagatgattcattacatcacttgcagcatattccttctcatcgtatgtatatctcttgaattctccctgttccgattttccgataagcacaactccagcacggtgacgtaccttgttgatggcattgatagctgactgaacatttccatcgcttgcaccgcctttaatcagacattctgcatacatcagatatatatctgccaaacggataagacgatagtttattcctgaggccatagcaggcttaaattcagtttcactcttacgtgtatcccaatttgataattttctgaaatacgctgaagagccacggttgaattttgatacctgttgtgggagagactgataatatatcagactttcatcgccgtttattgcaagagaggcagatgcacgcatggaatagcttctgaggcgatatgcctgaccgtcttcccatttaaattccggaactatgtcatcgtagccggtaatcttattgtataaaactttattatctccgacagttgagacgagtcgttcgcgtactccaacatattttcctgctgttgcatcccacgtataaacgtacgttctgttatatacgacaccctgacggtccacctgcgagctgaaagttgttcccaactggtcgtatataatatccctatgttcaggatcaccataattgtcggactgcatttttatccagttacgttcatcaagtctgtccaccggctctgtttcgaatgcttcaacaagccaaaaagcaggaacagtgttaagccaggcatcgcccaagccatttacattcattccccatatattatataaggtagactccgaccatgtaccgaattctgtattatactgtgtagaataggaaacctcgagaatagattccgaattgaattcattggcagcagtaaaattatcgactatgtcatcaaccaaagcaaaacctccattatcaataatatccttaaaatattcggcagctttattatactctttatcataaaggtagcttttgcctaatattgcctttacagcccaagaggtgatacgtcccaaatcggttttctcccatttgtcattcaagccaaggtcaagagctttctgtaaatcttctctgtaatatttcttgatttcatcacttggtgtaacctttttatagtaatcttcttctacctctgcaatttcattaatataaggaacattaccattattgaatgaattattgagataaaaataaaacaagccacgcaaagaatatgcctgtgcctcaatctgagcaagcttggttatttgaggttcatctgtaacatttggacggattttctctatactggccagaacctgattcgcacggaacacaccagtatacagtgcagaccatttaccacggactgttccgtatgaatcattaaaggtttgcttataggcttcgttatcaaactgctttctgtccttattaccttcaactgctatatcacttctacggttctcatcgagcggatgataaatattggtatttttcaaagcattatatacagcagccagtcctttctcgcagtcgcctattgttttataaaaattctgtgttgtcagctgatgtatgttttcctgcgtaaggaaatcgtcgcatgaaaccaatgtcatgcccgacatcaacagactgaatactattgttttatatctgaagttcatatatttatattattaaaagttagaaattaatctggaatccgccacgcatctggatacttataggatatgttccatagtccaaaccacgacgtgacaatccattactaccgacctcagggtcgtatccgtcgtattttgtcagtgtaagaagattatcggctgcaacgtataaacggaacttgcccaatccaagctttgatacccaactcttggggaatgaatatcctaacataatatttttaagtctgacaaatgaaccgtcctcaatccacatatcagtatgagcacgatagttgttatgcccctctgtacgataagaaggaatggtagaggtatagttggtaggggtccacatgtatatcagttccttattggttcttctttgatatgtatatatcttcgtaccgtttattatttcatttccaactgaagcataccagttcatagagaaatcgaagcctctatagtcggccgagaagttcaaaccaagttcataatccggcataccactaccggcataaacacggtcgtcatcattaagaacaccatcattattggtatcgatatacataaggtcacccatacgggcacttgactgtaatttctgatattctgcaagcttctgttcagtattgattacccctgcggttggcataacaaagaaagcaccggcttcatatcctttcttgattgcagttacataatcacttcctgatgaaacaggtttaccgtcggggaagaaatataactcattttttcctgccatagacacaatctcattcacgtttttggtaaatgtaccagtcaagctgtaattaacaccacgtattttgttgcggtgagtaagtgaaaactcaacaccacggttttccatatctccggcattcaatgtaacagttgaactctggccccctccatttgacggtggcacgaccatcgggaaaagcatattcttcttgttactcttgtacaaatcaagacctaagataagcttgttattatataaagccatgtcgataccggcattaagctgctgggttgtttcccatttcacattcggattggcaaatcccaattgggtaaaaccatttgcaagaatttcggaagttccggtaccaaaagtatagtcgtagtttttgtatatagctggtgcgtatgaataatcagggaagttctgattaccggtagtaccatagctgaatcttaattttaacgaatttactagccacctgaatctgtcgaagaatgattcctcagaaatattccatcctacagacaatgacgggaacaatccccaacgattttcttcggagaacttagatgaaccgtcgcgcctgatactggcacttgccatgtatttgtctgcatagctatattgtagacgacccaacataccaaccattgtactgatacggtcctgtccccactggccactgcctgtacccacagtcatatcggatgttcccgcatttaggttcggaatctcgttagtaaccaaatccattatactggcatagaacatctcgtatgtatatttctccatactgaaaactccggtaaatttaatatcatgcttttttatcttcttattataatttaccattgtttcccaagtgagactggtattctttgaatgagtatcttttaattgcgaacggtaattagagctggttaccttttcgcctttctgattatatacctcaaactcaggtcgaattgagacagctttctgattgttatatccaaagcccaaacgtgtggaaacattcagtccgggaattacattataagcaagataaaaattaccgttaaatgattctgtgtccttatgattttcctctttcaatcttcccaatgtataacttacgccctgtaaatctgcaggatcgccagctgcatttactatacttgcctgtggataaatctgagaacgagtaggcgagtagtcataacattcgttcaataacccccaagccggagataactggttttctatcttcatagcgatgttagtgttgatagtccattttccgcgctgaaaatgtgtattcgaacgaatattatatcttttgtaatcggaatttatcaacacacctttctggtcgaaatagttcgcggtaaggttatatgtcaaatctttcttgccgccattcgcagtaacagaataattctgtattggtgcgttattattgactacatattcatataaactagagttgttgaagaaattcacaggatatgttttcagattagaccaggccaggtcgtctgtattctggtttccttccatcattctgttagacatcacttttacaaatatactctcgttggcatcaagcaaatgaatattcgaagtaatgtgctgtacaccataatatccgtcgacagctatcttcatttctccttccttacccttctttgtggtaataaggataacaccggaagcaccgcgagtaccataaatggcagccgaagcagcatccttaagaatatctatacttgctatttcgctactactcaatcccgggtcgccctcgaacgggacaccatcgacaacatataaaggagaactgtcgcctgagatagaacttaaaccacgaatctggatgttggatttggctccaggctcaccagaacttgcctgaacgttaactccggcaaccataccctgaagagctgtacccaagtcggaagtactgatcttagtaatctcatctgagtttacacgtgccactgcacctgtcacctcttttttacgcattgagccataacctacaacaaccacttcatccaacacttttgtgtcttcctgaagcttgatattataaatctgaccattcttgattgcagcttttacagttttatacccaacaaaactgaacactaagttacctttagtcggtaccccttgaagaacgaaattaccatccatatcagtaatagttccaagagaagtaccttcaacttgaacagctgcgcctataacttcaaggttattggcagcatcaatcacctttcctttaactgttatcttctgtgaatacatagacaatgtatagaagataagcatcacgaacaacatgtacctgccatggtaccattttttctgatttctcatttgtaaaaattttaatttagcaataggttatgaaattccttttataactgacgctaaattatttatttataatggtacaaaaggggagaattatatatttaaaaagggggtaaaattttacccccacttatattaagaatccaaatcggtctgtatactctgttctttgtactgttgcggcaatacaccgaattctttcttgaaacattctctgaaatacttcaaatcattgaaccctacatcgtatgtcacctctgatacagaataccgtcctgtcttcaacagttctgccgctctcttcattcttattgaacgtacaaaagcattggctgttactcccataagtgctttcagcttcttgttcagaaccaaggccgtcacgccaagacctttacatatatcctctatctggaacgaagagtctgtaatgttgtcctctattatctttacaagtttctcaaggaacttatcgtcggtagatgtagtgcttacctcggaaatctttattgccggaactttcttgtgttgaagaatccgcttcctgttggttataatggaattaagcagctctttcattatcttgttgtcgaaaggtttagggcaataagcatctgcatggaatttatatccgatgaaataatcctgcaatgtagtcttggctgaaagcaatactacaggaatatgagatgtccttacatcctgcttgattctctcacacagttccagaccattcatgcccggcatcattatatcggataaaacaagatccggttgcaaatctggaatcatgttccatgccatctccccatcatgggctatcattatcttatacttatccgacaacagtaatgacaacatattacatatatccttattgtcatcaacaatcaatatagccggagattctccgtccacttctatgtctatcatctcttcatgctcgcacgattcacttcttaacacatcagcaaacttttcatcctccccactgttggcagagatattctccgtaaccatgtccccctcagttatcataggaattacaacatggaaaacagtgcctttaccttcctctgatacaaacgtaatatttccattatgtatctctacaagccgcttggtcagaaacagacctataccggtacctccttcagcagagtttttattctgactgtagaaacgctcgaagaggtgtgttttcaggttgtcggatattccgtttcccgagtctgccacagagatgtttattttgttatcctgttcattgacagtaaacgatacaaatcctccggcaggagtatgcttaatggcattcgatacgagattatagattatctgttccataagatgagggtcgaacagaaagcttatatcactgcgtgagacagaatattccagccctacacctttctgttttgcccaatacgtgaactgctgaaatacttcttttgagaaagacgagaagttgccatatttgagattcagactaagcattcctttctcgctctttgagaagttcatcagctggttgacaagacttaacaggaacttactgttatgctccattgtctgcagcatgccggcaagatacttgtcggacgaatacttgcccgattcaataatcatactaagtggagaatgaataagtgtgagtggtgtcctcaattcatgcgatatgttggtaaaaaatgtagtctccttttcaagaagttcttcagtcttgcgtttttccatgtttgctatatatagagcatttctgcgctgcacccgtgaggtataatacaccttgaaccggtataaagacaagacaagcaatataaaatagagtgtataggcataccatgtacgccagaaaggagggttaataatgacaggtatggaaagttcattcaaactgtagactccatcgctattcctgaccctcagtctgaacatatattcgcctgaaggaagctttgtgtagaaagcctcacgatgaaaagcggaggtggaaatccatgaatcatctacgccttcgagcatatattcgtaaccaaccttataaggacttctgtaatccagggagctgaactggaatgagaaagtgtttaaattataaggcaattcaatgtgctctgtaaaacttacacttttgtcgaaataagctgaatatgtggaatctgcctcaacgctgtgattgaagattttaaaatcaacgagtgtaggactaccgttgaaatctatcacatcaaagtcattaggtctaaagacgttaattccgtttacgccaccgaatatcattgttccatccgtcattactccagcagaaagttccataaattcataatcctgaagaccatcgaaaatatcataagatcttattctctgtgtgttgatattcaacgaattaattcctttattggtagaaatccataatgttccatccgtgccattaacaattgattttattgtattgctgctcaacccgtctgcagagctaaaattttcaacgcaggcattatggttttcatccaaatccacgattttccttaacccacgtccaagtgttccataccagatattatgattcaagtcttcacatacaggcactatatagtcgagttcatcaagtcccttgactgagttcaaaacaggattatctatatacaaatctgcagattccaatactttaagaccgaagctggaagctacccatatattacccttatgatctttaatgatgtttcttactatcttaagttctttattgtcagatgttttgatttccttcatcacacctgtggacaaatcatatctgaaaagacctttattatatgtgccaatccacaaatattttccatcggcaagcattgcgcgcacatttctcaaacctgagatctttttataatcattatcagaagtgaaactgtaaataccatcgtacatcagagacacatacatgcagtcggtgtagtttgagtatgctgttgagtatactatcctgtttgccgtgaaaggaataagtctggcattaccggtaatggaattaaaatgatatagccctgagccttctgtgcctaaatatatatcagatttggcaaatgtataaacggacgatatatgatcatttcctattcctctgaataaatctataggtttattattttcgcgtatactcataaagccactcttgaaaaatcctatccaaagaatatcgtttttatcaagaactacagtttgcggatagctgtaagaatatgtagcaataacctgtggttttgactcgatggcatgcaatacatcaaaagtcaacacattcacagtgcttgtagtggcataaaataatcttttgtttttatataccatttttcgtatatcacagttttccaacagggtacttaccttgcaggtatgcttgtcgtataaacataattgatgattttccagatttgagtacaatatttgagaagatgagatgactatggctgaagctatagggcatcccaatagtttgttaagcagtaattcatctccatcgacgttacattcgtacaggccgtcttcggaggagagcattatcgtattatctatttctatgatgtcggaaatgtatggtaattttaatgttgatcttaagacagtatttattttgccattttgaaaatcataatttacaaggtatatactttcatcagaggaatgaaaccagactctgtctttagagtcgacaagaatcttatcgcaagtgaaatttttatcaataccgctgtgaccaagatttaatgaaacgaattcgttctttacagaattgaacaggaacactcctctatcggctgtacctatccacagatttccatgtgaatcttcgtcaatacatactatcagattactgttaagaccgtttgactgatatccgtaaaccttaaattcatatccgtcaaacctgttcagtccgtcgttcgtggccaaccatataaagccttttgagtcttgataaatacattgcacatcattttgggaaagtccatcaagagtagtgtactttcttgtgacaaactcattggatgcaaaggatttgcaaactataatcagaactgatattaaacttaagattaatctaaacatataactattattctttatatttcatcaagattacaaagttattgattttatctaaaacatcaagtatttacagtagttaatagataattatagatattttccactttagaatgcgtatcaaaatcaatcaagaaaaaaataaatctttaacttcatttcatagtataaaacaaaaaaagcatcgtaccattacactcaataatagatacgatgcccgaaagaaattacagtaacagactgtattgggattgttcttaaaaagacttatctgtatgactttatatatatgtcgagtatttcggtatccgacagttcatgagggtccagactgaacaatgcacccatggcagttcgcgcattatcaatcatcttagggaaatcttcctttactattccccagtcgctaagcttcaaatcgcggacattgcattccttctgcattctcaccaaagcatctataaaatgttcgggattaaggttcttgcatccggtcataacatctgccatgcgcatatatctctttgtcctgtcataaataaaagtagagaaataggcctcgcttatagctatcaggccaacaccatgaggaagagcgggatagtatgcgctgagagcgtgctcgagagaatgttcggaagtacaactggatgtggattcaaccattcccgccagcgtacttgcccaagccacctttgccctcgctttcaggttatttccatccttcaccgcaacaggtaaatatttatacagcagtctgatggcctcaagagcgaaaatatcacttattggggttgcacaattggcaatatagccttcggctgcatgaaagaatgcgtcgaatccctgataggcagtcagatgtggcggaactgaaaccatcagttccgggtcgattatcgacagacatgggaaagttaaagtggagccgatacctatcttttcgtttgtttccagattggttatgacagtccatgggtcagcctcggttccggttccggctgttgtaggaatggctatgatgggcaatgctttgctgtaaggaagccccttgccggtacctccttcaacatattcccaataatcgccatcattacatgccatgattgcaatggatttggccgtatctatcgaacttccgcctcccaaacctataatcatatcgcaattttcctcacgacagattgccgtaccttccattacatggtcttttattgggttaggcaatatcttgtcgtacaccacggcatcaacattattttctttcagcagaccaatcaccttatccagataaccatatttacgcattgatgttccggatgaaatgactatcaaagcctttttgccgggcaatgtctctgttgaaagacgtttaagttcgccacatccgaagagaatcttcgtcggaatattataaccaaaaacaaaattattgtccataaatattatcagtcagtcaacttactatcttaaagcctcatcaatcactttcttgagttcaggataagcctcatctgtatcgcccacctgttttctcaactcacgcagtttctttttcatgtccttaagaactttggcgtatttaggattatcagccaggtttaccatttcgtaagggtcgttcttcacatcgtagagttcgaaagaaaccggagtaggaacaatcttgtggctgttcttcaaccatgacattgatttctgtccgtaacgtttgtcgtcgtaatgacggccatagaaaagtatcagcttatagttttccgtgcggatacctatgtgtgccggaacgtcgtgatgaatcatgtgcatccagtatctgtagtaaacagcatccttccagttttctggctttttgccttcgaacacagaggcaaagctctttccatccatgtatgaaggttctttgccaccgaccatctctataagagttggagcaaaatcaatgttgttaatcatcaggtccgacttggctcccttgtaaggacatctcgggtcgcggactatgaaaggcattctttgagattcttcatacatccatctcttatcctgcagatcgtgttcgccaagcatcataccctggtcgcctgtatatacgataatggtattttcccagagtccttccttcttgagatagtcgaaaagacgtttcaggttgtcatccacaccctttacgcaacgcagatacgatttcaggtaatgctggtaggcaaggtatgtattctccatttcatcacctgtattgcacttatattccattacataattgcggatttcatgacggcttgagacagaagttccgatgaagtgacgaagtgaatcgttcttgcctcttgtgccttcggagccccatttgtctgtatcgaacaatgacaatggaacaggcacttccacatcgtcaagataatattcatagcgcggtgcgtactcgaacatatcgtgcggtgccttgtaatgatgcatcatgaagaaaggtttggacttgtcgcgtctgttcttcaaccagtcaatagcaaggttggtcacgatatccgaggagtaacccattttctttatctggttattaggccatttcttgtcagttacgtcacttgtaaggaaaatagggtcgaagtattcgccctgtccgccatgaccgttgaatacagaataatagtcgaagtgcgacggttcgcatcccaaatgccatttaccgatcatggcagtctgatatcccatattatggaactcatcaaccagatattcctggtccggctgaagcacttcatccaaagtgagcaccttgttacgatgggaatactgtccggtcatgatacatgcacggcttggggtactgatggagtttgtacagaaacagttctcgaagagcataccgtcccttgccagttcatcaattgtaggagtagggttcagtactgcaagacgacttccgtatgcgccgatagcctgcgaagtatggtcgtccgacatgatgtagatgacattcatctgtttctgctgtgctgcgacaccaacacatacagacaggaatggcataacagccattcccttcattatattattttttaaattcgttttcataagtcagattatcattgaaatagaacttgcaagacatatcatcgaatgattttacgtccttattctgcattttaacccattgttctgatttagccttgacagcgacctgagttgaaacctcattaccgtcgactacacttttaagagtgacatttgcatcctctgcattatggtttgccacacgtacagtgataaggcatccgttatcaaccttatcgtatagcggtttggaaaccaccgcccctttaagcttaatcttgaacacatgtgcatattcagtaggtttgttcttagggaagtttactacaagaccctcgtcagtcatcttatagtcaatcttctctgagcttccaagcatttcaaccgactcaatttccacgttctggcaatacttaggagcaaatgacttgatagtaacactaccatctgtccaagccagagacacggcatagaggttattgtcgcgtgtagtaaagcgaatgtcgtccgctgtatattcagtttttgtattgtctgtcatataacctgcggtgcctgcgttatgtccttcgaaagcaatcacccatggtcgtgagccataaatagcctcaccgttagtcttcaaccatttacctatctcggcaagtacgttcttctgttcgtctgtaatagtaccgtcggccttaggacctatattcagcaataagttaccgttcttgctgacaatatcaacaaagtcgtcgatgatatggtcaggactcttgttttcctcgcccacacaatagctccacgatttcttgcctacagaagtatcagtctgccatggatattcacggattctgtcgctcttacctctttctatatcgaacacctggatattgtcgccatatccgaatttagtgttaaccacaacttctttattccaatcaagagccgaattgtaataataagccatgaatttatagaaagtaggctggaacggatattttcccacagtccagtcgaaccatatcaattcaggctgatatttgtcgataagctcgtatgtatgcataaggaactgacggcgtgaacgttcgttcgagccttcatacttaccacaataaggtgtcataccctgaccttcgggctcatgcagtctttcgccatacagagtgattgtagtgtcctgaacatcagaaggagtttccattccatattcatagaaccatgcattctcgcatctgtgagaagaaagtccgaaacgcagaccggctttcttggtagcttccttcaattcgccgattatatcccttttcggtcccatatccacagcattccacttattgaaagtactgctgtacatggcaaatccgtcgtgatgctcggccaccggaacaatgtattgtgctccagatgattttaccactgccagccactcgtcggcattgaaattttcggctttgaacatagggatgaaatccttatatccgaatttggtcaaaggaccgtaagtctgtacgtgatacttattaataggatgaccttccttgtacatccagcgggaataccattcactgccgtatgcaggaacggaataaactccccagtggataaagataccgaacttggcatccttaaaccattcaggaatagtgtaattttgagcaatcgatgccgaatcggccttgaacacatcagtaccttttaaagatacagtagaatctacattaggagcgtatgtagaattgcacgacgccaacaggcttaatgccgcaactcctaaaaccgttttcatggatttcttattcataataatcttattacattaaataatgacattaattttttctgtaagcaaagatacacttgagttccatttacaataaataatttaattactatagtaaggggtaaaatatttaccacctattattgaacaaatttaccccctctcatatatgataataaactgccaatatcgaattacaagtaaatatatatttcaacaaaaaaggtttagcctattattacacaacaatttcaccctaagaataaaatatatatagagtaaatttgccaatataacaaactgtaaaaacaaatttatgaaaaactatttgatttacttactcgcagcagtatcgtgtacaactgtagcagacctaaatgctcaagtcagtacaaaaacaggtaatgaaaccacagaacttacaattccgaaaaagttctacaaggacagcattgatttcagcaatgctccgaaaagacttaacaacaagtaccctctttccgaccagaagaacgaaggcggatgggttctaaacaaaaaggcctctgacgagttcaaaggaaagaagctgaatgaggaaagatggttcccgaacaaccctaaatggaaaggaagacaacctactttctttgcaaaggagaatactacatttgaagacggctgttgcgtgatgagaacttacaagccagcaggatcactgcccgaaggatatactcacactgccggtttcctggtaagcaaagaacttttcctttacggatatttcgaagcaagactgagaccaaacgactcgccatgggttttcggtttctggatgtcgaacaatgaaagaaactggtggactgaaatagacatttgcgagaactgccccggcaatcctgccaacagacatgacctgaactcgaacgtgcatgtatttaaagctccagcagataagggtgatataaagaaacatatcaacttccctgccaaatactatataccattcgaattgcagaaagactttcacgtatggggacttgactggagcaaggaatatatccgactatatatagacggagtactgtacagagaaatagagaacaagtactggcaccagccattacgcatcaatcttaacaacgaatcgaacaaatggttcggagccttgccggacgacaacaatatggattctgaatatctgatagattatgtaagggtgtggtacaagaaataagaaataacataatctgaaattataaaaggcagtcttcattatcagtatgctgatgataaagtctgcctttttaacaagaagataaagattttaatctgccctatcactcatttacttcatccggatactctgtaagcgagtttcccgaattgcttatttcaatagagccgataggaagataattgaacttcttgctccatgcagagataccataatctcttctaagaataggcatcatgacctcctcggcacgtcctgagcggacgaggtcaaaccatctgtcaccctcgcatgccagttcacaacgacgctcataccatagaacatcaattacgcttttaaatctgtcaggatacatctgcattagcttgtcaacatcaatataacttccgtcgtctgcatgaacatgcttctttctgagttcatttatgtaatacttcgcttttgcttcatcaggattagtacctctgagatatgcttcggcaagcatcagatacacttcaccatatctgatgacccttacgtttccaggcttgtttagattggggtttcctatcatatcgtaatttttgaaaggaggatatttcttctgggcatatccctggaaatcaggcccgtaagagcctgtctcccaaacaactttttttgattcatcctgaatattggcattaggtttggttacaagttcatcgtaagtaaatatcgccgcatcacgacgcacatggtcatccggaaggaaataatcatacaattccttagtaggcagacaaaagccatatccattatcataatcaggactatttttcaactgtctcggtccgcagaaagtcacccacatagcaccttcgcctgcatcaatattaccccagtttgtattaccagatttggtagaggtctgtatttcaaatatagattcctcgttattctcctgatgagccgcaaacaatttagaataatcatccgtcagagtataattaccacttgaaattacatcctccaataaaggtttcgctttgtcaaaaatcttagcatcatcgttgctccagtcagcccaataaagatagaccttggccaacagggcttgagccgcagtcttggtaatacgtcctttcattgtgtccgggaaattatcctttagagaagggatagcttcaagaagatctttctctattgctttatttacattttcgcgagtatctctcgtaaacttgaatccttcaggataaagagtctcaagactgataaagcatggaccataatatctcaacaattcaaaatgataccaagcacgtaagaacttagcttcagctttataaactttagcttccggactgtcatactctgaatttattacaagattacatctatatataccacggtaacgagttttccacaaattatcggaaatagaattgacactcgtatttgaataatcctctatagcctgcatgtaaggctgatcctgatcagagccaccaccagtacgagcattatccgaacggatttcacccataggtacaatggaagcaagtgcattacccgaagcaccacctatgtgagctaacggatcataacaagcagtaagcgctttgaacatctgttcatcggtcctataaaaagaactttctgtttcggacattataggagctgtatccaggaaactgtcgctgcaagatgatgatgcaatagcagcaaacatgaggacaagaatattattatgtattttcgacttcataattttcaattttagaaattaagacttaaaccaaatctgaatgtacgggcctgagggtaagtaccatagtcaatacctgtgctaagaatattgccacctgccatatttcctacttcaggatccataaacggatagctggtgaaagtggcaagattatcaattgctgcataaattcttgctttattcagcatcaacttgtttattaatttagttgggaatgaatagcctacctcaagtgaagaaatctttaaatgcgaaccatcataaagataaaaatcggatggtttgccaaagtttccattaggatctttggatgaaagacgaggcactccattatcatcaccttctttccgccatctgtcaagatagaatgatggaaggttgctgcgtccgtatgcttcctgtcggtaaatatcagagaagactttatatccagcttttcctgttaagaagattgtcatatcaatacctctccagtcggcacctaaattcaaaccgaatgtccattttggccaaggattgccacaatcggttctatcttcatctgtaatctgcccatcgttatttgtatcttgccatataaagtcacccggaacggcatcaggttgtatcactttaccgtcttttgatttatagttctgtatctgctcttcattttggaatattcctaagttcttataaaggcggaaataacccatagcatgaccttcctccatacgcgttacattaacagatgttctccagctaccaccatcagtatatccatttacatttcctatctttacaacctcatttttaagatatgaggcatttgcggaaatagagaagttgatttcgttccaatttttattaaatgtcatctgcatttccacaccctggtttgttatattaccaaggtttctaaaagctgcattattacctctaatggcttcaactgttggctggaacaacaaatccttagtactttttttaaaccagtcgaaacttgctctaatcataccattatagaatgtcatatcggcaccaacattaaattgttcagaagtttcccatttcacgtctggattaacaaggttattaggagcagatcccacagtgatggcattaccaaacgtgtaattataattattgccaataatagaagtataggagaatggagaaattcgctcatttccgttctgtccccaagagaatctaagtttgaagacatcaaagttcttaattttccagaatttctcatttgaaacattccaacctaatgaaacgcccgggaaagtagcatatctgttattgggaccgaaatttgaagacccatcgcgtctgaccacaacttccgccatatatttttcagcataattatagcttagacgagcaaaatatgagaacatactatgtctaggattagcaccgccactattagctgatgtcataacatcaccagcattaagataccagtaattctcattggtcattgcttcatttggatatttatttcgtgttccggccataaactcataaacatctcttgatgcagaagtacctaacaggacagatgtagaatgttcaccaaaagattttttatatcgcaatgtattctcccactgccaactactattagcatttgtactttgttctaccctagaattatcttctttacattctgcagaatgaaaaaactttggtgcaaacattcttccacggaaattccgatgattaataccaaaatctgtgcggaaaacaaggtctttaataaaagtgatctcagcataaacattaccaaaaaattgctgggtaatatttttattcttaggtgcctcatccataaatgcaatagggttccacatacggctataaggtacaggagagactccatatccgaaagtatcgttgctattctcatcataaaccggagtagtaggatcaatattataggcgtatgatatcggattataaccattgataccggttgccactccactattctctatatatgcatagttgacgtttgcacctacacttaagaaatcatttatagaataggaactgttcagccttgtgctgaatcgtttgtaaaatgacgcatcttcaccgataataccattctggtctagataattcaatgaaagcaagcttgaacccttatcactgccaaagttagcagtaatgttatgctcagtaacaggagctgtattcaatatttcattaaaccagtctgtattataacctgttggagcagtaggtacaccaccggcaagcggcatatcatcattgtcggcaaactctttcatcagcataatgtactgttcatcattcagcatggttggtttctttgctactgtagagaaaccatagtaaccatcataagcaagcgatgtctttcctttctttcctttctttgtggttataaggactacaccattagcggctctggcaccataaatagcagctgaagttgcatccttcaagacttccatgctttcaatgtcgttgggatttacactgttcatgtcgtccataggcagtccgtcaattacaaaaagaggattagagtttccatttgtaccaacaccacgaattaccagcttcggtgctgttcctggctgaccggaatttgtcacaacgttcacaccactaaccctaccgctcaatgcattcacggcatttgctggtttagattgcaataaatcatcggaatcgatgctactgatagcacctgttacaacactttttttcttaacctcatatcctattgctacaacttcctcgagtgcaatggcagatgtttttaattgaacgtctatcttagactgacctttatacactatattctgtgtatcatatcctacgaagctataaatcaatgtcgattccattggtacattttccaagatataatttccgtccaaatcagaaataataccgtttgtggtacctttaactaaaatacttgcacctatcacaggtaaaccatcggagtctgttatacaaccggtaactttcccgttctgtgcatttaatggtaaactgaacgttataagaatcagcatacacattaatgatagtgttctgttcataatctagagttttttgtaattagtgtttttcttaaaataaaaagttttgttctatcagttgcgcgctacttactgacacttgcaaatatatatactatgtaatataaccaaagggggaaaatttcatttaaataggggggggaaatagattaactaaatattttaaggaaaaatggctgttagaatccattcccagactccaacagccattttatcactaacaatcgcctgttaatcaatatatttttctgcccatttccttaagatttgcatccctgcccagtggaacaaaagtaaatccgtatgaatagcttcccttcagaagacgcttgtctattgaaggacgggctttcagactccagctatctgttccgcccactccagcctgaaccaggtcgatattaagagtattagaatacaagtccttttcaagttcatttatatgtttagccttatcaatcgcattctgcgacatctcccacactgaaacagataggggttcatcgccgacaatcatcacacctgccttatccgactgcaaggcaaaccatctcacgtcacaacggtttccgttttcctgcggcattacatagtcaaatcccagagcggacaccttgcagttatatatagacaccattgcagaggcttttctgtcggaatagttttcccatgggccacgtccataatatgtcacatccgacaaacgattggtacattcgcattgcaatcctacgcgcaacatttctgatatttcaggagacttcatcattgaataatgaacgcctattgttccgtctgcttttactttataattcaaggtaagtctcagtctttcatctatagcctttagcaccttaacctcaagattgccttccgatttgcgtacatctatagaaactgtctttagctttaatggagcatctttccagaatgcaaacagtctatcgaccttccatcctcgccagtcattgtctgttgacgctctccagaagtttggtttcagagcagatgtgatgatactttcattatctatcttatactgactgatataaccatcactgatattcagataaaagttctttcccttcacgctgatgtctttcttgttatctgaatcgatttccatatccaatgtagtatcaacgcattctactatctttggtaaagaaagatacttaaactgttcccaggcaacctcgtatccagctttggcatacagattgtcattcttgagcctggcactcaggaataaccaatattccgcaccgtcatcggccttgaaattctgaataggaagttttagtttacagctctcaccagctggtgttgtcggcacaataatctcaccttcctgcaatacactgtcttcgtccttcaattgccaaaaataacgatactcatctgttgaaaggaagaagtttctgttttttacagttatctctccactatagacattatcagttgtaaatgatacaggagcaaacacgtacttgcattcctcagtagcaggtttaatggagcggtcggcactgataacaccatttatacagaagttttggtcgttgtgctcccctttctcatagtcaccaccataattccatgatttcttattatatttccgttcattatccagcaatccctggtctatccagtcccaaatatatccgccggcaagcgcatcatgagaacgtattgcatcccagtattctttcagcccgccggtagagtttcccatagaatgtgcatattcacacattattatcggacggttcatgaccggattcttagtcattgctataagctcatcgaccataggatacatacggctaatgacatcgacgtataaaggatcatcgggattggcatacacacaaagctctttctttgccggtttgacatcttcgttcacattaaaatctatctcactagtaacgattgacgcttccttacgtccgataggtttgtataaaggattttccggctgtccttgcgccccctcgtaatgaacaggacgggttgggtcataatctttcagccatcctgacagagctgcatgattagggccgcatccagactcgttgcccaacgaccacataaacacagaaggatggttcctgtctctcacagccattcttaccactctctccatgaacgagttagcccactcaggcctattggacagataccccctttgatgatgagtttcaagattagcctcatccattacgtatataccatacttatcgcacagttcatagaaataagggtcgttaggatagtgcgatgtacggactgtattgaagttataacgcttcataagcagaacgtcttcgagcatctcatcacgtgtaacggtcttacctccggtctcgctatggtcatggcggtttacaccaatgagtttaataggagtgtcattcaccagaatctgattacctgttattttaatatccctgaaccctaccttattacttctcgcatccaccacgttgccctttttgtctgtgagctttataaccaaagtgtatagataagggtgttccgaattccatagttttggcttagaaacaattccctccatcattccgtaataaacattatcacgctgaggataaggttcgttcaccacataatcggcagtaacggtaatgtcttttccaaacaccggtttcccatcggcatcatataattgggctgacagattccatcccttcaaatcatccatattctgatttgttatttccggacggatctgtaaccgtgctatattcttccggaaatcgatgcgtgtccttactccataatcatatattgccacctgcggaatggacatgatatatacttcacgatggataccagccattcgccagtggtcggcatcttccatataacttccgtcggtccacttatacacttgcaccgccagtttattctcccccttcttaacgtattcggtaatatcaaattcagtaggcagacaactgtcttcggaatatcccaccttctgtccgtttatccatacattaaatcccgaatagacgcctccgaaatggagtataatcctgtcgctcttccacttgtcaggaacaacaaactccttgatataacaccccgtctgattattcctgtcaatatatggcggacgagcagggaaaggataaatagtatttgtatatataggatagccatatccctgcatctcccaacatgaaggaacaggaatagttttccatgatgatgaattgtactccactttataaaaaccggcgggagccaatgccatatcctcggaaaagttaaacttccattggccgttcaacgacatatactccgatttctctctgtctccatccaaagcccaatccactctccggaaagaataagtagtactgcgggaaggcaaacggttaattccgtttatggtctgatcctgccatacattctgattgtttctccactgattggcaccgttgtccgatgcagacagaaattgcatcatgaaaaataacacagaaaatgaaaaaatagattttaagttcaagttcataaattcgcattttaagtttctatgcaaatatataagtataacgaacaatgaatagggggtatttctatctatatagagtggtatttttacatatgagctaaaacttaaaaaaaactgtcagtattactatgctatgtagcactctatatgaaaatattatatattcccaagtcaaaagccttttcaaacaatttttatatattctcatcctatcccttccatcaaagataaattccaatcctgatttgccagccgcatttattccttttttcaggagaattttctttatggctatcgccatgaaaattcacctgaaaaagaatgcggcggcaaacggattagaattaaagaaaagattacagggattaactgcgaccgacgtgacgcatagccgtaattcaaaggcggctatccttatattccatatatgacctcacaaatactgtgaaaatccactttccccaataacaaaacatagcctgccatatcaacacccaaaa

SEQ ID NO: 64 - DNA, 6596 bp, Artificial Sequence
  Synthetic sequence
acggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtcccgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatcggcgcgccaacaaatactttcaggacgatgtaaagtcctgagaaatcaaactgaatggatagataaatattagtcttttctcatcggattcttttaatatcgctactcttttattatgtagtggttgtattatcttaaataaaacaaaaacacccgactttacattcttgggtgtaaaacagggtgtttgttttgcaatctgctgattttcagcgttttttgcggagagacaggctctcgaacttatactttcacagaatatcataaaactgcaaacgactgataatcaagtgtaaattacaatatagagtaaaagtaaatgtttctaaatgtcttttgctatctcaataattgggtgtatatttgggtgtagaatttcaaacgcacccaattatgaatatcaagcgcaacatcatttttgcattggagagccggaaaaagaacggtgtgccaatcgtagagaacgtacccatccgtatgcgtgtcatctttgccagccaacgtatcgagtttacaacgggctaccggattgacgtagccaaatgggatgcagataagcagcgggtaaagaacggatgtaccaacaagctaaagcaaagtgcagccgaaatcaatacggacttgctgaaatactatgccgaaatccagaatattttcaaggaatttgaggtgcaggaggtcatgccaacgacccaacagttgaaggaagctttcaacatgagaatgaaagataccagtgaagaacagccggaagaagcccctgtcagcttttgggaggtgttcgatgagtttgtaaaagagtgcggtaaccagaataactggacggcatccacctatgaaaaatttgcagcagtgaggaaccacctcaaagagttcaaggaggatgcaacgttcaactatttcaacgagtttggattgaacgaatacgtcaacttcctgcgtgacaccaaggatatgagaaacagcaccatcggcaagcaaatgggattcctcaaatggttcctgcgctggagcttcaagaaaggacatcatcagaacattgcatacgatacgttcaaaccgaaactgaaaaccacctcgaaaaaagtaatcttcctgacttgggatgaactgaacaagctgaaagactaccagatacccaaggataagcaatacctggaacgtgtgcgtgatgttttcctgttctgctgctttacgagtttgcggtattcggatgttcgcaatctgaaaagaagcgatgtgaagtccgaccacatcgaaataaccacagtcaagactgccgacagcctgacgattgaactgaacaaatacagcaaagccatactggacaaatacaaggacatccatttcgagaattacatggctctgcccgtcatcagcaaccagaagatgaacgattacctgaaagagctgggcgaactggcagaaatcaacgagcctgtacgggaaacctactacaagggaaatgaacgtattgatgaagtcacacccaaatacgctttgctcagtacccatgcaggaaaaaggacattcatctgcaatgcgctggctctcggaatcccggcacaggtggtcatgaaatggacgggacacagcgactacaaagctatgaaaccctacattgacatagcggatgatattaaggcaaatgccatgaacaagtttaatcaactataaaagtatcaaacagtttcatagatagttaccaatgactgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaacggaattgatccggccacgatgcgtccggcgtagaggatctgaagatcagcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctagctcaggcgcaatcacgaatgaataacggtttggttgatgcgagtgattttgatgacgagcgtggcgcgcc

SEQ ID NO: 65 - DNA, 7240 bp, Artificial Sequence
  Synthetic sequence
aaaggaatattcagcaatttgcccgtgccgaagaaaggcccacccgtgaaggtgagccagtgagttgattgctacgtaaataacttcgtatagcatacattatacgaagttatggactaggcgcgccagaagagagaaagaaggaaagcggccgcacaggtttcccgactggaaagcgggcagtgagcgcaacgcaattaatgtgagttagctcactcattaggcaccccaggctttacactttatgcttccggctcgtatgttgtgtggaattgtgagcggacaacaatttcacacaggaaacagctatgaccatgattacgccaagctatttaggtgagactatagaatactcaagcttgcatgcgatacgtatcgttaacgatggatccgacgcacgtgcgaattcgccctatagtgagtcgtattacaattcactggccgtcgttttacaacgtcgtgactgggaaaaccctggcgtcacccaacttaatcgccttgcagcacatccccctttcgccagctggcgtaatagcgaagaggcccgcaccgatcgcccttcccaacagttgcgcagctgaatggcgaatggcgcctgatgcggtattttctccttacggcggccgcttgacataacttcgtatagcatacattatacgaagttatgtttaaacattagcagaaagtcaaaggcctccggtcggaggcttttgactaaaacttcccttggggttatcattgggtcgagaccgcctgaagaggacttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaagcaacttcagacaatacaaatcagcgacactgaatacggggcaacctcatgtcgcctgaagagtgagaccgtcccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaaaatgtaatcacctggctcaccttcgggtgggcctttcacacttgcatcggatgcagcccggtgaacgtgccggcacggcctgggtaaccaggtattttgtccacataaccgtgcgcaaaatgttgtggataagcaggacacagcagcaatccacagcaggcatacaaccgcacaccgaggttactccgttctacaggttacgacgacatgtcaatacttgcccttgacaggcattgatggaatcgtagtctcacgctgatagtctgatcgacaatacaagtgggaccgtggtcccagaccgataatcagaccgacaacacgagtgggatcgtggtcccagactaataatcagaccgacgatacgagtgggaccgtggtcccagactaataatcagaccgacgatacgagtgggaccgtggttccagactaataatcagaccgacgatacgagtgggaccgtggtcccagactaataatcagaccgacgatacgagtgggaccatggtcccagactaataatcagaccgacgatacgagtgggaccgtggtcccagtctgattatcagaccgacgatacgagtggtaccgtggtcccagactaataatcagaccgacgatacgagtgggaccgtggtcccagactaataatcagaccgacgatacgagtgggaccgtggtcccagtctgattatcagaccgacgatacaagtggaacagtgggcccagagagaatattcaggccagttatgctttctggcctgtaacaaaggacattaagtaaagacagataaacgtagactaaaacgtggtcgcatcagggtgctggcttttcaagttccttaagaatggcctcaattttctctatacactcagttggaacacgagacctgtccaggttaagcaccattttatcgcccttatacaatactgtcgctccaggagcaaactgatgtcgtgagcttaaactagttcttgatgcagatgacgttttaagcacagaagttaaaagagtgataacttcttcaacttcaaatatcaccccagcttttttctgctcatgaaggttagatgcctgctgcttaagtaattcctctttatctgtaaaggctttttgaagtgcatcacctgaccgggcagatagttcaccggggtgagaaaaaagagcgacaactgatttaggcaatttggcggtgttgatacagcgggtaataatcttacgtgaaatattttccgcatcagccagcgcagaaatatttccagcaaattcattctgcaatcggcttgcataacgctgaccacgttcataagcacttgttgggcgataatcgttacccaatctggataatgcagccatctgctcatcatccagctcgccaaccagaacacgataatcactttcggtaagtgcagcagctttacgacggcgactcccatcggcaatttctatgacaccagatactcttcgaccgaacgccggtgtctgttgaccagtcagtagaaaagaagggatgagatcatccagtgcgtcctcagtaagcagctcctggtcacgttcattacctgaccatacccgagaggtcttctcaacactatcaccccggagcacttcaagagtaaacttcacatcccgaccacatacaggcaaagtaatggcattaccgcgagccattactcctacgcgcgcaattaacgaatccaccatcggggcagctggtgtcgataacgaagtatcttcaaccggttgagtattgagcgtatgttttggaataacaggcgcacgcttcattatctaatctcccagcgtggtttaatcagacgatcgaaaatttcattgcagacaggttcccaaatagaaagagcatttctccaggcaccagttgaagagcgttgatcaatggcctgttcaaaaacagttctcatccggatctgacctttaccaacttcatccgtttcacgtacaacattttttagaaccatgcttccccaggcatcccgaatttgctcctccatccacggggactgagagccattactattgctgtatttggtaagcaaaatacgtacatcaggctcgaaccctttaagatcaacgttcttgagcagatcacgaagcatatcgaaaaactgcagtgcggaggtgtagtcaaacaactcagcaggcgtgggaacaatcagcacatcagcagcacatacgacattaatcgtgccgatacccaggttaggcgcgctgtcaataactatgacatcatagtcatgagcaacagtttcaatggccagtcggagcatcaggtgtggatcggtgggcagtttaccttcatcaaatttgcccattaactcagtttcaatacggtgcagagccagacaggaaggaataatgtcaagccccggccagcaagtgggctttattgcataagtgacatcgtccttttccccaagatagaaaggcaggagagtgtcttctgcatgaatatgaagatctggtacccatccgtgatacattgaggctgttccctgggggtcgttaccttccacgagcaaaacacgtagccccttcagagccagatcctgagcaagatgaacagaaactgaggttttgtaaacgccacctttatgggcagcaaccccgatcaccggtggaaatacctcttcagcacgtcgcaatcgcgtaccaaacacatcacgcatatgattaatttgttcaattgtataaccaacacgttgctcaacccgtcctcgaatttccatatccgggtgcggtagtcgccctgctttctcggcatctctgatagcctgagaagaaaccccaactaaatccgctgcttcacctattctccagcgccgggttattttcctcgcttccgggctgtcatcattaaactgtgcaatggcgatagccttcgtcatttcatgaccagcgtttatgcactggttaagtgtttccatgagtttcattctgaacatcctttaatcattgctttgcgtttttttattaaatcttgcaatttactgcaaagcaacgacaaaatcgcaaagtcatcaaaaaaccgcaaagttgtttaaaataagagcaacactacaaaaggagataagaagagcacatacctcagtcacttattatcactagcgctcgccgcagccgtgtaatcgagcatagcgagcgaactggcgaggaagcaaagaagaactgttctgtcagatagctcttacgctcagcgcaagaagaaatatccaccgtgggaaaaactccaggtagaggtacacacgcggatagccaattcagagtaataaactgtgataatcaaccctcatcaatgatgacgaactaacccccgatatcaagtcacatgacgaagggaaagagaaggaaatcaactgtgacaaactgccctcaaatttggcttccttaaaaattacagttcaaaaagtatgagaaaatccatgcaggctgaaggaaacagcaaaactgtgacaaattgccctcagtaggtcagaacaaatgtgacgaaccaccctcaaatctgtgacagataaccctcagactatcctgtcgtcatggaagtgatatcgcggaaggaaaatacgatatgagtcgtctggcggcctttctttttctcaatgtatgagaggcgcattggagttctgctgttgatctcattaacacagacctgcaggaagcggcggcggaagtcaggcatacgctggtaactttgaggcagctggtaacgctctatgatccagtcgattttcagagagacgatgcctgagccatccggcttacgatactgacacagggattcgtataaacgcatggcatacggattggtgatttcttttgtttcactaagccgaaactgcgtaaaccggttctgtaacccgataaagaagggaatgagatatgggttgatatgtacactgtaaagccctctggatggactgtgcgcacgtttgataaaccaaggaaaagattcatagcctttttcatcgccggcatcctcttcagggcgataaaaaaccacttccttccccgcgaaactcttcaatgcctgccgtatatccttactggcttccgcagaggtcaatccgaatatttcagcatatttagcaacatggatctcgcagataccgtcatgttcctgtagggtgccatcagattttctgatctggtcaacgaacagatacagcatacgtttttgatcccgggagagactatatgccgcctcagtgaggtcgtttgactggacgattcgcgggctatttttacgtttcttgtgattgataaccgctgtttccgccatgacagatccatgtgaagtgtgacaagtttttagattgtcacactaaataaaaaagagtcaataagcagggataactttgtgaaaaaacagcttcttctgagggcaatttgccacagggttaagggcaatttgtcacagacaggactgtcatttgagggtgatttgtcacactgaaagggcaatttgtcacaacaccttctctagaaccagcatggataaaggccaacaaggcgctctaaaaaagaagatctaaaaactataaaaaaaaaataattataaaaatatccccgtggataagtggataaccccaagggaagttttttcaggcatcgtgtgtaagcagaatatataagtgctgttccctggtgcttcctcgctcactcgaccgggagggttcgagaaggggggtaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggtcggccgcggtgtctcgcacacggcttcgacggcgtttctggcgcgtttgcagggccatagacggccgccagcccagcggcgagggcaatcagcccggtgagcgtcgga

SEQ ID NO: 66 - DNA, 72558 bp, Artificial Sequence
  Synthetic sequence
aacaaatactttcaggacgatgtaaagtcctgagaaatcaaactgaatggatagataaatattagtcttttctcatcggattcttttaatatcgctactcttttattatgtagtggttgtattatcttaaataaaacaaaaacacccgactttacattcttgggtgtaaaacagggtgtttgttttgcaatctgctgattttcagcgttttttgcggagagacaggctctcgaacttatactttcacagaatatcataaaactgcaaacgactgataatcaagtgtaaattacaatatagagtaaaagtaaatgtttctaaatgtcttttgctatctcaataattgggtgtatatttgggtgtagaatttcaaacgcacccaattatgaatatcaagcgcaacatcatttttgcattggagagccggaaaaagaacggtgtgccaatcgtagagaacgtacccatccgtatgcgtgtcatctttgccagccaacgtatcgagtttacaacgggctaccggattgacgtagccaaatgggatgcagataagcagcgggtaaagaacggatgtaccaacaagctaaagcaaagtgcagccgaaatcaatacggacttgctgaaatactatgccgaaatccagaatattttcaaggaatttgaggtgcaggaggtcatgccaacgacccaacagttgaaggaagctttcaacatgagaatgaaagataccagtgaagaacagccggaagaagcccctgtcagcttttgggaggtgttcgatgagtttgtaaaagagtgcggtaaccagaataactggacggcatccacctatgaaaaatttgcagcagtgaggaaccacctcaaagagttcaaggaggatgcaacgttcaactatttcaacgagtttggattgaacgaatacgtcaacttcctgcgtgacaccaaggatatgagaaacagcaccatcggcaagcaaatgggattcctcaaatggttcctgcgctggagcttcaagaaaggacatcatcagaacattgcatacgatacgttcaaaccgaaactgaaaaccacctcgaaaaaagtaatcttcctgacttgggatgaactgaacaagctgaaagactaccagatacccaaggataagcaatacctggaacgtgtgcgtgatgttttcctgttctgctgctttacgagtttgcggtattcggatgttcgcaatctgaaaagaagcgatgtgaagtccgaccacatcgaaataaccacagtcaagactgccgacagcctgacgattgaactgaacaaatacagcaaagccatactggacaaatacaaggacatccatttcgagaattacatggctctgcccgtcatcagcaaccagaagatgaacgattacctgaaagagctgggcgaactggcagaaatcaacgagcctgtacgggaaacctactacaagggaaatgaacgtattgatgaagtcacacccaaatacgctttgctcagtacccatgcaggaaaaaggacattcatctgcaatgcgctggctctcggaatcccggcacaggtggtcatgaaatggacgggacacagcgactacaaagctatgaaaccctacattgacatagcggatgatattaaggcaaatgccatgaacaagtttaatcaactataaaagtatcaaacagtttcatagatagttaccaatgactgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaacggaattgatccggccacgatgcgtccggcgtagaggatctgaagatcagcgggattaaaagtcggggattggtgaacaaaaaggtgtttctctctttaagagaaatatcgttttgctaaacagttgatattgaggtatcattttatcgtaaaagacatttttgctcaacaattgcttgacggaaatcaacaaattttagcattttgtaaaaaagtcgctatataatttggtgaattggagttattttcatatttttgcatcccgaagagtttctcttaaagagagaaacatcttttgcataccttttccgaccgaatttttatgtcgtaaagaggggctttgcagggggtggactcagaaagatgagaatagatgactattgtagttgaaacacatagaaagttgctgatatacagaccgatacgcatatcgggatgaaccatgagtacgttcttttctcaaaaaacataaatattcgaaaagagatgcaataaattaaggagaggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctggattggtaaagagatgtaattttgtaacggcgatagaaattgattctaaattatgtgaggtaactcgtaataagctcttaaattatcctaactatcaaatagtaaatgatgatatactgaaatttacatttcctagccacaatccatataaaatatttggcagcataccttacaacataagcacaaatataattcgaaaaattgtttttgaaagttcagccacaataagttatttaatagtggaatatggttttgctaaaatgttattagatacaaacagatcactagcattgctgttaatggcagaggtagatatttctatattagcaaaaattcctaggtattatttccatccaaaacctaaagtggatagcacattaattgtattaaaaagaaagccagcaaaaatggcatttaaagagagaaaaaaatatgaaacttttgtaatgaaatgggttaacaaagagtacgaaaaactgtttacaaaaaatcaatttaataaagctttaaaacatgcgagaatatatgatataaacaatattagtttcgaacaatttgtatcgctatttaatagttataaaatatttaacggctaaaaacaataggccacatgcaactgtaaatgtttacgcgggtaccgacaccgcggtggaggggaattatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctagctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgccagaagagagaaagaaggaaagcggccgcacaggtttcccgactggaaagcgggcagtgagcgcaacgcaattaatgtgagttagctcactcattaggcaccccaggctttacactttatgcttccggctcgtatgttgtgtggaattgtgagcggacaacaatttcacacaggaaacagctatgaccatgattacgccaagctatttaggtgagactatagaatactcaagcttgcatgcgatacgtatcgttaacgatggatccgacgcacgtgcgaattcgccctatagtgagtcgtattacaattcactggccgtcgttttacaacgtcgtgactgggaaaaccctggcgtcacccaacttaatcgccttgcagcacatccccctttcgccagctggcgtaatagcgaagaggcccgcaccgatcgcccttcccaacagttgcgcagctgaatggcgaatggcgcctgatgcggtattttctccttacggcggccgcttgacataacttcgtatagcatacattatacgaagttatgtttaaacattagcagaaagtcaaaggcctccggtcggaggcttttgactaaaacttcccttggggttatcattgggtcgagaccgcctgaagaggacttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaagcaacttcagacaatacaaatcagcgacactgaatacggggcaacctcatgtcgcctgaagagtgagaccgtcccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaaaatgtaatcacctggctcaccttcgggtgggcctttcacacttgcatcggatgcagcccggtgaacgtgccggcacggcctgggtaaccaggtattttgtccacataaccgtgcgcaaaatgttgtggataagcaggacacagcagcaatccacagcaggcatacaaccgcacaccgaggttactccgttctacaggttacgacgacatgtcaatacttgcccttgacaggcattgatggaatcgtagtctcacgctgatagtctgatcgacaatacaagtgggaccgtggtcccagaccgataatcagaccgacaacacgagtgggatcgtggtcccagactaataatcagaccgacgatacgagtgggaccgtggtcccagactaataatcagaccgacgatacgagtgggaccgtggttccagactaataatcagaccgacgatacgagtgggaccgtggtcccagactaataatcagaccgacgatacgagtgggaccatggtcccagactaataatcagaccgacgatacgagtgggaccgtggtcccagtctgattatcagaccgacgatacgagtggtaccgtggtcccagactaataatcagaccgacgatacgagtgggaccgtggtcccagactaataatcagaccgacgatacgagtgggaccgtggtcccagtctgattatcagaccgacgatacaagtggaacagtgggcccagagagaatattcaggccagttatgctttctggcctgtaacaaaggacattaagtaaagacagataaacgtagactaaaacgtggtcgcatcagggtgctggcttttcaagttccttaagaatggcctcaattttctctatacactcagttggaacacgagacctgtccaggttaagcaccattttatcgcccttatacaatactgtcgctccaggagcaaactgatgtcgtgagcttaaactagttcttgatgcagatgacgttttaagcacagaagttaaaagagtgataacttcttcaacttcaaatatcaccccagcttttttctgctcatgaaggttagatgcctgctgcttaagtaattcctctttatctgtaaaggctttttgaagtgcatcacctgaccgggcagatagttcaccggggtgagaaaaaagagcgacaactgatttaggcaatttggcggtgttgatacagcgggtaataatcttacgtgaaatattttccgcatcagccagcgcagaaatatttccagcaaattcattctgcaatcggcttgcataacgctgaccacgttcataagcacttgttgggcgataatcgttacccaatctggataatgcagccatctgctcatcatccagctcgccaaccagaacacgataatcactttcggtaagtgcagcagctttacgacggcgactcccatcggcaatttctatgacaccagatactcttcgaccgaacgccggtgtctgttgaccagtcagtagaaaagaagggatgagatcatccagtgcgtcctcagtaagcagctcctggtcacgttcattacctgaccatacccgagaggtcttctcaacactatcaccccggagcacttcaagagtaaacttcacatcccgaccacatacaggcaaagtaatggcattaccgcgagccattactcctacgcgcgcaattaacgaatccaccatcggggcagctggtgtcgataacgaagtatcttcaaccggttgagtattgagcgtatgttttggaataacaggcgcacgcttcattatctaatctcccagcgtggtttaatcagacgatcgaaaatttcattgcagacaggttcccaaatagaaagagcatttctccaggcaccagttgaagagcgttgatcaatggcctgttcaaaaacagttctcatccggatctgacctttaccaacttcatccgtttcacgtacaacattttttagaaccatgcttccccaggcatcccgaatttgctcctccatccacggggactgagagccattactattgctgtatttggtaagcaaaatacgtacatcaggctcgaaccctttaagatcaacgttcttgagcagatcacgaagcatatcgaaaaactgcagtgcggaggtgtagtcaaacaactcagcaggcgtgggaacaatcagcacatcagcagcacatacgacattaatcgtgccgatacccaggttaggcgcgctgtcaataactatgacatcatagtcatgagcaacagtttcaatggccagtcggagcatcaggtgtggatcggtgggcagtttaccttcatcaaatttgcccattaactcagtttcaatacggtgcagagccagacaggaaggaataatgtcaagccccggccagcaagtgggctttattgcataagtgacatcgtccttttccccaagatagaaaggcaggagagtgtcttctgcatgaatatgaagatctggtacccatccgtgatacattgaggctgttccctgggggtcgttaccttccacgagcaaaacacgtagccccttcagagccagatcctgagcaagatgaacagaaactgaggttttgtaaacgccacctttatgggcagcaaccccgatcaccggtggaaatacctcttcagcacgtcgcaatcgcgtaccaaacacatcacgcatatgattaatttgttcaattgtataaccaacacgttgctcaacccgtcctcgaatttccatatccgggtgcggtagtcgccctgctttctcggcatctctgatagcctgagaagaaaccccaactaaatccgctgcttcacctattctccagcgccgggttattttcctcgcttccgggctgtcatcattaaactgtgcaatggcgatagccttcgtcatttcatgaccagcgtttatgcactggttaagtgtttccatgagtttcattctgaacatcctttaatcattgctttgcgtttttttattaaatcttgcaatttactgcaaagcaacgacaaaatcgcaaagtcatcaaaaaaccgcaaagttgtttaaaataagagcaacactacaaaaggagataagaagagcacatacctcagtcacttattatcactagcgctcgccgcagccgtgtaatcgagcatagcgagcgaactggcgaggaagcaaagaagaactgttctgtcagatagctcttacgctcagcgcaagaagaaatatccaccgtgggaaaaactccaggtagaggtacacacgcggatagccaattcagagtaataaactgtgataatcaaccctcatcaatgatgacgaactaacccccgatatcaagtcacatgacgaagggaaagagaaggaaatcaactgtgacaaactgccctcaaatttggcttccttaaaaattacagttcaaaaagtatgagaaaatccatgcaggctgaaggaaacagcaaaactgtgacaaattgccctcagtaggtcagaacaaatgtgacgaaccaccctcaaatctgtgacagataaccctcagactatcctgtcgtcatggaagtgatatcgcggaaggaaaatacgatatgagtcgtctggcggcctttctttttctcaatgtatgagaggcgcattggagttctgctgttgatctcattaacacagacctgcaggaagcggcggcggaagtcaggcatacgctggtaactttgaggcagctggtaacgctctatgatccagtcgattttcagagagacgatgcctgagccatccggcttacgatactgacacagggattcgtataaacgcatggcatacggattggtgatttcttttgtttcactaagccgaaactgcgtaaaccggttctgtaacccgataaagaagggaatgagatatgggttgatatgtacactgtaaagccctctggatggactgtgcgcacgtttgataaaccaaggaaaagattcatagcctttttcatcgccggcatcctcttcagggcgataaaaaaccacttccttccccgcgaaactcttcaatgcctgccgtatatccttactggcttccgcagaggtcaatccgaatatttcagcatatttagcaacatggatctcgcagataccgtcatgttcctgtagggtgccatcagattttctgatctggtcaacgaacagatacagcatacgtttttgatcccgggagagactatatgccgcctcagtgaggtcgtttgactggacgattcgcgggctatttttacgtttcttgtgattgataaccgctgtttccgccatgacagatccatgtgaagtgtgacaagtttttagattgtcacactaaataaaaaagagtcaataagcagggataactttgtgaaaaaacagcttcttctgagggcaatttgccacagggttaagggcaatttgtcacagacaggactgtcatttgagggtgatttgtcacactgaaagggcaatttgtcacaacaccttctctagaaccagcatggataaaggccaacaaggcgctctaaaaaagaagatctaaaaactataaaaaaaaaataattataaaaatatccccgtggataagtggataaccccaagggaagttttttcaggcatcgtgtgtaagcagaatatataagtgctgttccctggtgcttcctcgctcactcgaccgggagggttcgagaaggggggtaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggtcggccgcggtgtctcgcacacggcttcgacggcgtttctggcgcgtttgcagggccatagacggccgccagcccagcggcgagggcaatcagcccggtgagcgtcggaaaaggaatattcagcaatttgcccgtgccgaagaaaggcccacccgtgaaggtgagccagtgagttgattgctacgtaaataacttcgtatagcatacattatacgaagttatggactacgcaggtcaatatccggaacatgaaacccgcaggttctgaaatccgcatattcagaacatggggattcgggaagcgcagcaatacgggcagtctcaggttcgatgctccggtcaggaaatgggaatacagagaaccgaatccgttatatgacggttacaccacccgtaactggttccgctatcatatcatgaaacaccgggacagggaaaggacaggcgaatacaccttccgcagcgattcattcacgctgtacagccggagcgagctggacgagctggccgcaatcctgaaaggcagactctacaagggaatcctgcctgactctcttgtactttggggataccgcatggatattaaggaaatatcacgtgaacagtggaacggtatgggacagcacggacaaatccgcatgaaattcatgggatacggtccggtcagaatccacacggacaatgaaaaccataccgtaacagtatacagaatcaacgacatattgtcttcaactatcagaattttcatattttttcagttctttttttgtttcttctattaatattttaagccactccatgatttgtattgcatgttcatgaacagtttcattttggctatcactgtcgtgtagtagcctttgaaaatcacgtaaaatattgtctttcccaagcatctcccatacaggcatcatccggtggattatttttctcatggtctcacggtcggttatcctgtcagcagattccatctcctccagttctttttcagattccataacaacgagagaaagcatatgactataatcatccgtattctccagtaaactggaaaaatcgaattctccggaaactgaaacttgtgtacgagatataatggtggataaaaaagcaagcagtccgtggatattgaacggtttatgaatacagcctacaaatccttctttttcataaattccggaatttccgtcaccacgggcagtcatgactgctactggaacagttctagaattgccgatgtccgaattgcgaagcaatcttaacaaaccgaatccgtcagtatcaggcatttgtacatctgtcaagatcaaatcatattcagaattttcaagagcggccactacttcacgtgcattcttacaggttttacaggatatacctttgcgcccgagcatatcttccgctattttcagttgtataggatcatcgtccactacaagaacattcttaggcaatatagttattgtattatggtccgatttgtcttcctcaactaactcatccgtttcaggcaaagaaagttccagtctgaacatgcttcctttaccgagtacactttctacatccatttttccttccaaaaccttaattaatcctttggtaaggaaaagtcccaaaccaaacccttcagaattgacattctgtgcggcacgctcaaatggagcaaatattcttttcagtgtttcctcatccataccgataccagtatcccttatttcaatacgaagttttccttctgaatattctgaatggaaattgacgttacccctggaagtaaacttaatagcgtttgtaagtagattggctaaaacctgttcaagtttgtccgcatcaccttttactattacatttgatcctttatgttcagaatataaaatcagaccttttgaagtcgctttacgagaaaactcatctgaaattcgttgcaagaaacggtcaagataaaatggtgtgtcgttacgcaaattaccggcttcattgattcggtaagcatccatcaaatcattaaccagatgtaaaacgtgtcgacaagaatgacggatgtcatctaaatatttttcgcgcttcctcttttcacgcgtttcagataccaaatctgcacagttatggatattaccaagtggacctctaatatcatgagaaactgtcaggatgattttcttacgcatatcaagcaaattctcgttttcttgaatagcttgttgtaatttaaatttaattatttcttccttacgtaaatctgattgtataattaaaaatgaaattaatattataaaaaccgcaatactcatcattacgataaataatcgaaaggattcttgtttgacttccgttacctctaagtttcgttctataaatgacagctgtacctgattatctaaaaaagatacaaaatcatataatttttgatttaacagcctattctgcaaacgcaagctatccacataagtttctatctgattgtttcgcatatctatgacagaaaccaatctattattaaaattctgtatttcattagttatataggggacttgtatcgtctccttctttccgaataatccggcaattcctttctttttctgagttattgtcttcacttttactgtttgagtagctattacaggcaattcattagtaagaatactatcagatttattcgcaaattggactgctttcattatttgaaacaagtgcatttctttcgttttaagcaattcccgtaaagaatcaatttgaactggacataaaaaatcacaactccttaattttatttcaagtagaacactatctgttttaaaacgttgattatgaaatatgttataatcagactcatcccatactataactgattcgcctaaagttgccaacttagtaatatacaaatgaactttattagtattctcataagcttcattaatttgaattatcagattctcaagttctttcaaccggcaacgttcatttatcattacagtaaccatacttaagactataaatcctgtaataaaatatccaataaatagtcttttgcgtaataatgaagtcatcaggaacattctattgatttatttgacatcataattctatatatttaactagtcatagtatatatcattctcaaatatttatttcaaattcaagcaataaaataaaaaaacacttcatattacaactgaactcttttatgaaaaagttgaatatatgaagtgtttttttattacgatataaactataaaatcctattcttcgggaactggtgtataaacccttatccagtccaccaggaaggtgtggtcttccacatttttcagttcctcatccgtagggcttaaacctttaacggctctccagctttggtcttccatatttattatgatgtccatgtcttttaccagacctgtaccaccagtgtagttgttggggtcgataatatccttgccgcttacggttctgacaagttctccatctacataatattcaagtgtgaaagggtctttccagaacactcctacacgatgaaaatcgtcgcgccacaatgttcccttgtcatccttataccatgagccaagatctttcggctgataatccttgaatggctggcggatgaatatgtgatggctcaggtgaagtctgtcggcaccgtaacctccgccgtctctgtcgccgccgtatgcttctatgatgtcgatttcctgagtatcgtcagggctgagcatccatacatcggatgccatggttgaatttgaaagttttgcgtatgcctctacataaaccggatactttacacgtgtcttcgatgtgatacatcccgtataggttcccggcagttcctttgtgttgggtccgcttacaactttcttcatggggacatcttcaggacggctggctcttattttaaggtatccgtcggaaacggaaacatggtctctctgccatattgtaggagcaggtcctgtccaatgattatgatagaaatcggtccatttggcatagaactcttttcctttatccttttcgtcggcaacataattaaagtcgtccgactgtggatggagtttccacaccataccgtcgccggcatcagcgggtacaggatagatatcccactcgtacgatttattattgaaatcttctgctgcacaggctatttgcagcgatgctaaacaaatggtaaacagttttctcatcgtggtatcttagtttaagttataataattattttcgttcttttgattcacctttagcggtatgtgtctgcaatgtccaggtagaaaatctcattatgctctgatagtctgaactgttgtatatatgagtaagaccccatctcaatatttcggtaggttctttttcggcatctgcactgcggttcaggccaatggcgtgtggcgcgccttttactactgacattatttcaaagtttattccgtcaggcgaccactggagtgtgttcttttcaggaccgtcggtggtgataagtgaagctatacctcctttgtaaggccatacgcaaacttcatgcccgctgtttgaaataggattatattccgatttcacatacggacccataggattttccgcaatagccactccgtgtttgatttcacggccgccccatgttatttcttctcccatacgttcgcctttgtagtacatatagaacttacctttataaggtattatacacgggtcgtgtaccttatgactgtcgaaatcacctttcgacactaccttgaatctgttatcctcatcgccttcccattcgccggtattagaaggttccagtacaggcttgtctgtcttgatccacggtccttcaggggaatcagcacatgccataccgatagtattctttacacggactgtgtaaggggattttaccgcctgatagcaaagataatactttcctttccattccatcacctcaggagtgaagactgaacggtcgtcgtaagcacctttttcaccacgtttcactgcaattccctgttccttccatgtccatccgtcttttgatgtggcataccatatatcacatctgtcccatgggaaaaccttatctttctctatatctccagcaaatccttgggtaggtccatagctctttgaataccatacataatatgtattacctattttcagcattgcactcgggtctcttcttactacgccctcttcataagcaagatcacctttaagtggttccatcttatactcaaagaaccatttattgtcgtgattttcccatttcatggcacgtttcatagctgcacttaacttatttcccttaggtattcccaatgaatcggccttacgctcatcataattctgagtgtcgtcaacggcaatagtctgtgtattgcctgtatttccgcatgctgccaatagcgacatcatgccggctgcaagaataatttttctcatactagactttattttatattaattgttagtttattcgagtgtaattcacttgtttctgcactgatattcagtaccgatgatttttctgtcgactgaagcatcagcatacatcttccctgatatgtcataatatccttactttgatatggagaaacgttcttcacgtttccattgtctataccaagcagacggtactctccatcaatgttgaacttaagcatctgttctgttgtctttacaggattaccttttttgtctgttagctgagctgtgacatgcagaacatcctttccatttgctgcgatactttgtttgtcaaccgtcagcaatatcgaatgttctttgcctgaagtccttatagctgtagtggtattacctaacttattttttccttttgcggtaatagtgccaggcttgtactgaactgcccatttatagatatgatcctcaaaatcgtctatatacttctttcccatcgacttaccgttaacgaaaagttccacttcatcacaattggaatatatctctactattaccgagtcacctttctgataattccagtgagagtttacatcatcccaaacccataattttctatcccattcatgtcctttcttatcagtaaatccatcttttacatggagatacgaagatttgtctgtagtctgtgaatatatagcaataaaaggcttgtctgtccacaatgatttcatcatgtcgtacgaaggcttcacatagccgcacatatccaggagaccacatcctatcgacttttgaggccattttgaaagacggctttcactttctcccagataatcgactcctgtccatataaacatacccggaacgaaatccctttcaatcaccgccttccattcgtgccactgaccgagattttctgtacccattataggcttgtcaggataattcttcttagcataatcatacatcacgcgacggtagctgaagcctgccacatcgagcgcgtcgatatatcctgactcaaagcttatggaaggcaggatgcagttggcggtaactacacgtgtggtgtccatctggcgtgtccatgcagctaatttttgcgctgtacggccaatgtcgtatgcatgtttaggctggattttccacatttctctgattttttctttagagtatggaggctgattccagaaataattaccgttggaatcggcaccgaagaaacctgtcgcctcgcggcatccggtataagtccattctatttcattacctatactccactggaagatacaggcatgattacggcttctcctcattacgtttttcaaatctctttctgcccattcctggaaatgctcgcaatagccatgcgtaggatagtcttctacagtttccttcatattgagtcttttatctttgggataatcccactcatcgaagaattcttcctgaaccagaagacctatctcatcgcacaaagacagaaactcttccgctcccggattgtgcgagaggcggatggcattgcatcctccttcctttagggttttcagacgccggtaccacacatcgcgtatcattgccgcgccaaccattccggcatcatggtgcaggcatactccttttatcttcatgtttttcccgttaaggaagaaacctttgtctgcatcaaaacggaatgtccgtatgccgaacctgacagtgttttcagaaattacttcatcgccattcttgatgcgtgtctcggctgtatagaggacaggtgtatcgacgctccacaaatcaggctgtttaatctcagatacgatgtcgataattttctcctcaccagcattcagttttatactgaagacctcaaaggctgcgatattgcctttattatccttatatactacctcaacaactgcagctctgggttcggagtagctgttgcacacggtaacctggttgtttactttagcatatttatcagtaaccacgggagtagtgacaaatgttccccaaaccggaatatgcagtctgtcggttacaatcattttcacatccctgtatatacctgaaccggtgtaccatctgctgtcggcataatggctgtggtcgacccttacagtcatacggttatcctcattgggattgagatagtctgtgacatcaaaataaaaaggagcatatcccgaaggatgatatccaagctttttgccatttatccaatactcagaattattatatactccatcgaacactatatagcatttctgatttgcactgattgttgtgggaaatgatttgctataccatcctattcctccctgaaggaaagctacacatccttcacccgaaatggaatcgtaaggtaaaccaacactccagtcatgtggcaggttcactttcttccattcatcaccagggacataagaagtatatgaataatgagcagaatctttcagtacgaatttccaatctttattgaaatcaacatttgaatcagatgctgaaacctttagggttgataataggattattaaagctaaaagatttttatttctcataatcttaggttttacatgttttttgatgtcacaaaactatatctttcacttataatatatgagggggatattaatgtgatatagggtgggaaatcagaattttacatctgccctgtattccaccgtcacctacaaccttgacaaaggatgttcctttcttccctcttatggttctcaggacaaacagacactttccgttatatgtccttacactattgtttatgacgttgatgttcaaatcttctatcgaaggcgatccattgtcgagtccggcaagttcaagcttgtcgtcgaggattatcctcacatccgaaggtatatcgactactgtgtttccttctttatcttcaatggatacttctacatggataaggtcataaccgttgtcggtagctgttttgcggtcgcagttcagtgccagacggcacggcttgccgcttgtggacaaagtgtctttcgacaatattctgtcgccgtccttgcctaccgcaaggagtgttccttccttgtatgccaccttccacatcagtatattatgctccatgaaatcgctgcgtttctttgttcccaacgatttgccgttcagaaacagttccacttctggggcgttggtatatacctgcaccagtatgtcctcgtccctgcggtacttccatttatcgcgtgtgtcgtaccactcccagcgtctgatccatcccgggcgtggagtgtaggtgaaacttccgtcagtatccatcttgaactcgctttccttttcaggtattgttacaatatgggttttcggtgtgtctttccacagacattcaaagaaatggccacgcgctgtcttgttgcccacgaaatcgaagaaagaacagtctccaccccttgcaggccatgggccgttctcgccaagatagtcgaatcctgtccacacgaagatgcccgctatgtacttcttgtcggccacggctgtccattcaaagagctgaccaacattctccgaaccgataataggctgatatggatatagcttatggtcgatttcataatatttgtctttatagttatatcccactacatcaagaacgtctgtatatccggagagacgcgaaactgacggaacaacgactcctgaagagacgggacgggtagtgtccacatccttaacccaaccggcaaggacagcggctgtttcagccaaatcgtcttttcctcctgacagacggttgaactctttcagtatagacttgttgtctgtttccgggtcgcccgtatggataagacccttgaaccctttattgtctttgctcgatgcccagtaatatggataggtccattctatttcattgcctatactccagagtatcacgcaaggatgatttctgtctcgcctgatgaacgacttgaggtcgtgctcggcatgcgtatcgaagtatctggtatatcctattgatatgctgtcgggcgcatcttccttagctcgctcagtaatccactttttctttgccaccttccattcgtcgataaattcattcattacaagaagtcccagactgtcgcacatttccagcagactttccgaatgcggattatgggctgtacgtatggcattgcagcctatggaacgaagtttcagaaggcgtcgcaacagggcatcatcgtatgcggcaacacccatacatcccaagtcgtggtgtatgttcactccttttatttttactgattttccgtttagaaggaagccttcatccgcatcgaatttaatgtcgcggataccaaattttgttgttttcttatccatcacatatccgtcagaagcaatcagagtagtatgaagctcatacatcgaaggcgtttcaagactccagagatgacaattctccagttcaacagatgcagtgaactcattgaaatcgcctttcagggcaacaaaatcatcggaaacagaagctattgtcttgccgtcgtacactacttcgtgcttcacggtgactccttttacacctgttccagcattcttcacctcgcataccacattcaccatcgaacggttgcctacctgtggtgtggtaacgaatattccgtctgaaggaatatagagctcgtttcttagaataagactcacattcctgtatataccggcaccgacataccatctgctatcggcatacgctcttctgtcaacgcagacagttattgtattcatcgaaccttttggtttcagatattgagtaagttcatattcaaatcccacatatccgttaggacggaatcccaacatatgcccgtttatccaaacctttgagttattatatacaccttcgaaatgaatgaacacttttttcccattcatatcatccgaggtgagaaaattcttcatgtaaatccccacaccgccagacagaaaaccattgcttccggctgtctgagtcttggtatatccttcgctgatactccagtcatgaggcagacacacatcctcccactttatatctggactcaggaacaaagtgtcctgaggcacgaaacctgctggtttgctgaatttccaatcgaagttgaaatccactttagtggaggttccggcataacagaatccggacagaaagatagttaagactgtgataatgttttttatggtcatatcgattttcagattaatattaatgacaaaaataatttcaaaagtgtaaaaacaaaaaaactctccatttatatttcagatatcaacggagagtttcatcattaaaaaaaataaaacattttataaagttactccttgcttaaggatagctatttcccggtatcccttcttttcgttcagtgcctgctttccgcttgccacttccaccacaaagtctataaaacgtctgcttaaagattccatgctttctccctctaccagagttccggcattgaaatcaatccacgtatgtttctgttcataaagcggagtgttggtcgaaaccttcacggttggaacgaatgttccgaacggtgttccgcggcctgttgtgaacagcacgatatggcatccggcagaagcaagagccgtacttgccactaggtcgttgcctggtgcgctcaacaggttaagtccgtgtgttgtgacacggtcgccatatttcagaacatcctccaccatcgagcttcccgacttctgtgtacatcccaatgatttctcctcaagcgtggaaatacctcccgccttgtttcccggtgaaggattttcatatattggctggtcgttgcggatgaagtagttcttgaagtcgtttatcatggccactgtgtcgtcgaatatctccttcgtgcggcaacggttcatgagcagtgtctcggctccgaacatttcaggtacctccgtgaggactgttgtcccaccctgggcaacaagatagtcagagaacaccccaagcatcggattggccgtgataccggacagtccatcagacccgccgcacttgagtcctatacgcagttttgacagggggacatcagtccgcttgtcttccctggctatggcatacatctcacggagaagtttcataccctcttctatctcatcatctactttctgagaaacaaggaaacggatcctttgggtatcatagtcacctataaactcacgaaaggcatcaggctggttgttctcacagccaagacctacgacaaggacagctccggcattgggatgaaggaccatgtcacgcaatatcttacgggtgttctcatggtcgtcacccaactgcgagcatccgtagttatgagggaaagatataatggagtcaaccccctcgcaacctgtttccttgcgaagctgctcggccaactggtttactattccgttcacgcaacccaccgtagggataatccatatctcattacgtatgccggcttctccgttagcacgcaaataccctttgaatgtatggttctcgttcgtgaatgtctgtttctcgaacttcggagtgtaagtgtatgtactcagaccggaaaggttcgtcttgacggttttctcgttcagcagatgtcctttcctgacttcctttacagcgtgcgatatggggaaaccgtattttatcaccatatcaccttctgcaaaatccttcagggcaatcttatgaccggcaggtatatcctccattaattctatggaattgccgttcacctctattacagtccctttggacaatgggtgcagtgccacagccacattgtccgcagggtttatctggatatattcagtcataacaaactaacatttataaattgaagaatacaggtagaagtatcaacctacaaggtcttttactgtctgaagcattccttcgctctggattttgttgatatagtaaattacacggtctgccagtcccgagatagtattaaggtcttcaccccaaatggaagtatcggcgagaactgtcttcacaagattttctaccgagccatcgttccacaaacttgtaagcatcgccatgatttcctgtgcatcgttaggaactatctctacaccatcggcacgctttccacctttgtagtatactatgatggctgcaagaccgagtacaagtccttcaggaagcacacccttacgtttcagatattccttcactcctggaaggtcgcgtgtggcatacttagggaatgagttaagcatgattgatgttacctgatggtctacgaaaggattattgaaacgttccaggacatcatcggcaaacttcttgagttcctctttcggcaggttgagggtctccatcagctcgtcgaacatcacacgtttgatgaacttgcctatcacctcatgttggcatgcgtctctcacgatattgacgcccgaaaggaatgccaccggcgacaatacagtgtgaggaccgttcagcagagtaaccttgcgttcatgataaggctcctccgacgggacgaacagaacgttcagtcccgccttgtttgcaggaaattcttcggcaaccgattccggtgcttcgataacccacagatgaaaagcctcgccctgtacaactaaattgtcatcaaagtatagtttagtttttatgttgtctatgtctttacgagggaaacccggtacgatacggtccaccagtgtggcatatacaccacatgcagtttcaaaccatgacttgaactcttcgccaaggttccacaattcaatatactgatagattgtttccttcagtttgtgaccgttgaggaagataagctcgcatgggaagatgatgagtcctttcgacttgtcaccgttgaaatgtttgaatctgtgataaagcaactgtgtcagcttgcccggataagagcttgcaggagcatcctcaagcttgcacgacggatcgaagttgataccggcctcagtagtgttcgagattacgaatctcatatcaggctgttccgccagtgccatgaagtcattatactggctgtatggattcagcgcgcggctgatgacatcaatcattctgaatgagttcaccacctcgccattgttcagtccctgaagattgacatgatacagacagtcctgggcattgagggcatcaaccatacctttttctataggctgcaccacaacaacactgctgttgaaatctgtcttttcattcatattcgagataatccagtcgacaaacgcacgaaggaaattaccttcgccaaactgtatgatacgttccggacgtactgcctttactgcagtcttactatttaaagctttcattgtaatgccaaaaaattaaaattgataagattaaaattcaaccaacattctgaataccttacctggattttccgaccatttctgcagagcctcgcctgcctcttcaggtttcactacggcagagataagttcgttcatcgggcagttgccattctgaagataatgtatcacggcacggaaatcctcaggcattgcattgcgcgaaccgcgtatgtcgagttccttctggacaaaatattttgtctggaaagccacttcactcttggcatagccgatacatgccacacggcctgtgaaacctacaatgtcgatggcagtaacatatgtgataggactacccacagcctctatcaccacatcagccatatagccgtcagtaagttcccttactctttccaccacattttcagtcttcgaattgataaccatcgaagcacccaggcgttttgccagttcaagcttctcatcgtcaatatccaatgctattacccttgcgccacgaagcgatgctcttactatggcgccaagtccaatcattccgcaaccaatcacggccacagtatcaatgtcagttacctgagctctcgacacggcatggaaacctacgctcataggctcaatcagcgcacattccttatccgaaagaccggcagccggaataacctttgtccaagggaggacaaggaactcctgcatagaaccgttacgctgaacacccaaagtctcgttgtgttcgcaggcattcacacgtccgttgcggcatgaagcacactttccgcagttggtatatggatttactgtcacgttcattcccttctcgaaaccgacaggaacgccttcgcctatttcctctatcacagcacccacttcatgtcccgggatgacaggcatcttcaccataggatttcttcccaggtaagtattaaggtcggaaccacagaatccgacatatttgatacgaagtaaaatttctccggctccaagtgttggtttaactatatcagctacttgaacctttccggcttcagtaatttgtacagctttcataatctatgtatttatttaaatttgttattgtattattttgatgttgcattaattcaatgttgttttttctctatcttatatcctctccagccataatatgccgtaaagaagaaacatatcagaggtattacatatgccacctgatagaagtccgcgttatgattcatcacaaatgcggtgaactgagggatgcacgcattacctataatagccatcacaaggaatgccgaaccactctttgtgtcctcgccaaggtcgcgtagtgcaagtgagaactgggttggatacattatcgacatgaagaacgacactgcaagcatggcataaagtcctgtcataccaccgaacatgataattactccacacagtatgatatttactatagcgtatgtaagcagcatatcctgaggtctgaatttcgacattagcatagtacctatccatctgccgccaaggaaagccagcatatacagtccgaagaatgtggtcgcctcatcctccgacagacctgcatacatgcagcagtaaactaggaacaggctgttgatggctgtctgccctccgttatagaagaactgtgcgataactccccatctcaggtgtttgcgtttcaacactgcaaaattgataagcttgcccttctcgccgtgcgattcctccttgtcaatatcaggcaacttatacagtgcaaacaccacagcaagaataatcagcaggactgcaagaaccagataaggcatcttcatggagtctgtctccatctgaataaatccgtcccaacctccgggaaagtcggcaggcagagtctcgcgagtatagttctgtccggtaagtataagcttactcagaaacattgcggatatgaaagcaccaagaccgttgaacgactgtgcaagattcagtcttcttgaagccgtatcgtgtgtacccagagctgtcacatacggattggcagcagtttcgaggaagcacattcccgttgccatgatgaagaagattacaagatatgcccagtattcctttatctcggctgcagggaagaaaagcagaccaccgatggctgcaagaatgagaccgacaattatacccgacttatagctgaaacgtttcatgaacattgctatcggtatgggaaacaggaagtaggccagccaataggcagcttcagtgaacgaggcctcaaaagcattcagttcacaggttttcatcaactgcctgatcattgtaggcaatagattactgctgatagcccacatgaagaacaagctgaatatcagtaaaagcggtataaaatatttgtttttcattctgacatgtttttaatataaggtaactcaggcagattcttgaaaccgtaaaaggctttcgcgttctcgcccaagaaaagttttttgcttctctcttccaattcttttgatttaatcacaaagtcgtacgacatcttgtaggtaatggctgtgattgtgcgtggatagtcggaaccccacatcagtttctcgaagccaacaaggtcggcagcttcgttgatggctctgacagcgctgcggaacggatagaactcgtcattgaacagccaagtgataccgcccgactcaatcatcacattcttatgacgggcaagcattatctgcttcttccaatccggtttagtcaccataccgaaatgcccgatggcaatcttcaagtacggacattctgaaatgatttcttccatctcgcccacctggaggtctccctctgccatatctatggaaagaatcacccccttgtcttccattagatgaaacatcctcatcatctcgtccgagttgagcatcaccctaccgtccttcagttgcaggcggtgtcccggaatctttatggccttgaaccctttgtctataagttcaaccgcctggttatagaaacccggttttctgaattcacacataccacacacgaagaacctgtccggatatttcgtcatcacctccatcagatagtcattctgaatgccgtcgatatactcctgtgtgacaacagccgcgccaatcagggcataattcatattagccaggaaaacctcagccgtgtttcttccgtcaatcataaagggggggggagcatttgtctcacctcccccataaacaatgattgaccgttctctgtagtcttgattttcaggccatctacttcagtgtcctgataaagccacagatgcgaatgggcgtcaattattgtataatccatagaaacagtatttatgaatttgcccaacttactctttgctgatcgcctattatctccttaaccttttccacaaggctccagtctatcggttcctcaatgtattttatgttctgaagcacagactctgttcttgccgagctgaacaatgttgtaggtattctcggattgcttacagagaactgcaccgcaagtttctcgatagggtatccctgttcagcacaatacttggcagcctttgcacacacctcaatcaatggttttggagccggatgccattcaggaacacctctatgtgtgagaagtcccataccgaacggcgaagcgtttatcactcccacaccattttcgtcaaaatagtcgaggaagtccaccagcttgtcgtcgttcaatgaatagtgacagaagttaagcaccgcctctactgtacccggagcggcatggtcgataatccatttcaggttttcgagctgcaggtcggtgatacccacgtggcccaccacgcctttcttcttcagttccaccagagcaggcaatgtctcgttcaccacctggttcatatccgagaactcaacgtcgtgaacgttgataaggtcgatatagtcgatgttcagacgttccatactttcgtaaacactctcctgagcgcgtttgtccgagtagtcccacgtattcacaccgtccttgccatagcgtcccacctttgtagaaaggatgaacgattctcttggcaattccttcagagccttacccaatacggtttcggctttataatgtccgtaatatggagaaacatcaataaagttcagtccgcgttccactgctgtaaaaacagactgtatagcgtcactttctttgatagaatgaaaaactccgcccaatgaagatgcgccataactcaatacaggaaccttaagtcctgtctttcccaattcacgatattccatttttgataaataatttaaaggttaatattttttactctgtttattcttattcatacagatagaacatacgttccatcatcttccatttctcgtccgatgtggccccctcggcacactgctggaatttggctacgtattcttcccattcggcctgacgcggcagagtggcaagctttgccatagctgtatcccagtcaaaatccagaggtgtttccactatcataaagagttttgaccccaatatgtatatttccatttccaggattcccacctcgcgtattccggcgcgtatctcaggccatgcctcttccttactgtgagcctttctgtaggcttcaatcaattccggattctcacgcagactcaatgtctgacagtatctcttcacaggcagggaataacttttcactttatatccttctgtcttcatgatattattgatattaatatgttagtattacatgtcactgtctttatcttttcgacgatgctaaagtatgaagtatccatcaaaacaatagaggagattttcaaaaaagaaagaggggatattataccccctctttttcgacatttttacccctcataaaggagataaaaagtcaccccaaactctataaaaaatcaaaacagattgaactgcattcctgtgtagaaaaatccctggttggatttcggattccaatacgtcatcaccgtcaacgggatttcatattccataatccgaagtttataaatcacattcagggacacctgagtaattcctgccgattcggcatacatggttctgttcaccatttccccgctttcatttcttgaatttctcaatgcgaaagctgttccaataccaggaccgacccttagcttttcgttctgatagatggtatagcccacatatacgaaactggagtagatgttcttgctgttgtccagatccctgtcgcgaccgtaaacaagtgtagagaagctcaactccagcggaaatttcctgtcgcccgtataattgaccatgagatcaacgaaacgtccagtttcatcaggcttatagttgaagaactccttattattatatgtagccccgggcgagaaattatatgtatctatagcctttatctgaaacctgccatgagtatatgctatatactggctcagctccttataactccccctggtgttcgatccgccaaggaaaccggcggtaaacctccccgatgggtcggaaaccgacaaatcggacgagagaatcagtccgtcggccacttcaatgccacgccatagaatcatgttctgtagagtagtactgaaatgaagctgagcctgaacatttgctgacaaaaatataaatacaggaattaacagtcgctttttatacttacaggtatccaatgataatatatgtatcatactcagagcagtagaaaatcggttttaaattattattatggatttatttgtcgaaatactctataagattataaacattccagttaatatccgacatgtatttggtcaatgatgtataaggtttatagttataatcgagcatacctttattgcaatcctcatcatccagatacttgaagaaaacccatcctacacaattcttggcttcgagcagtcccaaggtaaaatgctggtaagcgaatccacggttttgctggtcgcgtaccacgaaaccagctccacttgaattgtcaagcttagtatcctcacccttggtatagaattccgttaccatgaaaggagtaccgcccgcctggttcttccagccatccatgtagcctttttcaggcgaccatttactataataatttatggaaatgacatcacaatattttcccgctgccttaattatataactgttgtatttaggaaggctgtgcaggcgtgaacccagataaagcaattcaggatccttcgatgccttaaccgcattctttatggcagaataatatttttccgcacaaataccggcaaactcattgttcagttcatccgttacatcagaaacatttgcactcttgtccttatccgtcataaacttggcggctgcaatataagcaggatcctgcttgtttgaaattttcaggaatctgtcgagcagcctgtttccccatgtagagaagtctatctcattatccgagaagaatcccaacacatccgggttgtttctgaacatgccgaaagcatccgaattgagatactccttgcaccattcatcccatccatcataaaacacaagacctatcttaagattcacgttctgccccggatagctaattcccttgctattcttgaactctgcaaggaatgaaaaggaaggagcctgtgtcagaggacttgaagccgatttattataatcatttacagccttgtcgccttcttccttaccgaaagcgcagacactatgaaatcctatttcagagaattgtttctgcgactttgccacccagtcatctactgaactgtaaagcttgccgaaagctgagctgttgccatccattctgaatgaggcgataccccttacataatatggataaccttcggggtcgactatccaacttcttccatttgagtttttctcaaccctgaaccgtccagtagccttggatttttgcccttttgcgtatgagccatatttattcacgctttgcaaatactcatcctgtgtttttgtctgctgttcataaccaaccaggtatggcaatatccttgtctttgcctctataaaagccttgtcaggtttttccgcatactcgacaattatcggttgatactgcttggtgctattaggataggtttcagcaggaccgggaacaggcagttgcagttctacatcatcatcgtcattatcgcctgcattgtcgccgggagtattatagtcctccacattccccggttgtgagtaaataacctcaggcggaatatatgagaactcctcctgagggtcttcacatgacaaagcgaagaacggaacactcaagcaaatggttttagtaataatagtagaatatttcattgttgcaaatatttagtaaattaatataaatcccatgtcctgattgtatccccccatcggtggtctatcgggaactccatttctccccatgccttaacagaagtccaaggttggtcggcatcagtccagaatgggtcagaggcaggcaatcccaacggaaggaatgcaagtgtagtcatatacaggctgccattgtttgtataatgattcgaaatgccagtctgatgtccgcagaatcctatggtgaggaatccgccctcattgaagttattgcccgacttgaacatacgtttcatacacgctgtcagcgcacatctcacctgtgctttcgatactcccgccggcaactcattataccatgctataagagccagtggctgcattgttgccatacggtaaggtatagagcgtccgaaaacagggaatgttccttcaggagatatgaaacgctccagaatcatggcgaacctctgtgccctcatcaatgccctgtcatagtacttgcgatagtcgaaacgtgtcctcacgcccgattccattattgcatgtatagattcgagatacataggatggaacacataactgctataataatcgaatgcaaagtgctgtccgtctgcgtaccatccgtcgcctacataccattcctccaccttgcggaaagtagaatttatacgatatgtatcctgtccggcatcaattttggcaaggaagctttcaatggtggccgagaacagcagccagttagtgtaaggagggtcaatgcgtcggagacctttgaactcttttatgtagcgttcctttgttgtctggtccagcggtttccacagctggtcgaacgcgcgcaggaaactttccgcaatataggcagcatcaaccagtgcctgaccatgaccgttccacaacagataatccggactattagggtccaccgcatttgcataactcttcaatgcccattctttcagttgcttgcgctgctgtccttctgctgtatcatcgtcaggcaggctcaaccatggagctataccggccatgagacgtccgaaagtttccatatatgcaaccttcttgttacggttatcccagtttggacttacctcaagaatcatatttttctgcagttcccctttcgccatattgctcaacacaggagcagccatcctgtaagccatatccgtccagtattttcttgtctcgttgttgtttgcctcgagataacgcacatactcgcaagcggcaagaaggaatgcgcctaccccaaagttggcagtcgacttggcgtcaaccacctgtcccggaatagccttttcaccgattggctggacataacccaccgaccagtctttctgcagtgcagtcttggtaagatatttccatgctttccccactacaggcataaattcatccttgtcaagataaccgttgtttatcccccaaagcataccgtaagtgaagaaagcggtaccgcttgtttccggtcccggagcatgttccggatccatcatacttcttgtccagtagccctccggctgctgcagacatgcaaccgcctttgccatacgcacaaacttatcctcgaaaaaagacagatgctcataaccctccggcaggtccttcagcacctttgccagagcggcaagcacccatccgtcgcctcttgcccagaaatccttctttccgttcagactcttatgcttgggataaacatattttgcgtcgcgataatagagtccttcctcctcatcatacattattgagtccgacgtacaaagatattcatacagtttcttaagataccggtgattatgcgtaatcttatacatcttcgtcattaccggcatcaccatataaagtccgtcgctccaccaccagtaatccttacgcggtgtgctcatctggtactccatgacttcgcgtgcacgcttgattttataattctccggcatgacgttatacaagtccgcataagtctggaagcacacctgataatcgccgaacagcacataatcatcctttaccccgtatttatacttccattcagatttgttgttgcttttcgcacccatccactggttatactcagcccatgcctccgaatactttctgtattcttctttcccagtaaggaaataggcttccatattaccggtgtgatatgccgcataatcccagaaagaccttgcttcgggggcatgatttttctgccaggcatcgttcactttttcaatcatctccctaacttgctgagcctcagtttttttttgcgaaggaaaatgaaggtaaaacagctataaggatgtataacatccagtagtatctataacagttcatctttgtgatattgtttacattttctaaaacgaaatggggaagaatatatattcctccctcatttcacgaataattgtattattatatttatttgttaggagtccattctgctccgttgttgaaaccttctgttgtagagtcaaaacttgcatctgctcctgtacttggtctttctgtaatttcttcaatcttaaaagaagtgattttagcggttccagtagcatcagtaccaccagggacattagtctgtacagttaaaataacgttctcaagaaccggccacacaagtgaaccatctgctcttgaagctggagtttcagcagaagtagaactactgattgtgaatgtatttgtataggttccacttccggtatttcttccaatccagaatttatatttatcagatgctcccaatctgaatgttgttgcacagtcgttagatgcgtatgtataagtaaatttgtaagtacaaccatcacggaatgacattgatttagtaactgggaattgattatctgctggaacaatttccaattctccacttgcattaattttttcggcaactccttctgcaagatattccttaactgcatctatgttagcgaagttaaaatcaaaagcatctgcatgagtcaaagcaacattggcagattcaatcttgatattagcatcttcgttgttttcgtttttagcagtcaaagcactaacagcataatcagtgttataacttacgctaatatttgcgtcattactataaatcttatcaccaagaataagagtcatagtagttccattcacagaaccggaagcaacaggaattgtttttcctgctactgttatggtaaatgctttgttaacagcatcagtgaatgttccagaaacttccttatcgagtgtaagttcaattcggtcattacctgttgtctgatcaggaacaatttctttagctgaagaaacggcaacagtagtttgtttttccaaatccacaggaggttcaccgcctccttgatcatcattcaatactatcgttacaatctgtcctttagtaactataaggttttcaccactgaagttataagttttagtaccagaatttcttgtaagttctaaagtaaatccatcggtaaatgtcaccggagctacaaccattgagtattccttggcatttttattttgttcattaggaccaacaaatgttccctctttagcggttagagttataacattagaaccggattccactgtcaggtttgctgaagcatcaatttttacgttccctgcaatctttacatcaccaccagcagtaagtttaatacctgtaaggtcagtaagattatttttaaacttaaccaatccacaagtattctggaaagttaaagatttgttattatctgttgcagtagcataagatatatttgcatttgcatcgaatccccaagccggagctgtctgttcagatggcagtgtagtagttacgacaccttcaagacacacagcttcggcattataaggataaagagctgtatatgaattgttaggtgtagccttacctgtaaacgttgtaactgtgctaccacctgtagcggtagtaaacttgttattttcttggcctgaaaagatattgattgcatctcctgttgtccaccacaccgttgttccattctgcaacgaactacggcttgaaggcgtaccggcaacaaaagtcatatcctgaggaccactgactgcatttacattcgacagttcgtcttttgtacaagactggagcattgcaatactcatcaaagccgctccacaaaatagcatcgtatttttcatgacataaattatttgttaaacagtttcaataataaaaaatcacatcacttgttattcatattcttattctttaggatcaggtttccattcagtaccgtcatcttcaaaatcatcatgaccgccatctacaattccgggaggtattgatattcggcataccgcactttttattccattacccgtatctacagaagcaccgatattagaatctctgcccccgtcgattgccacgaccgtacatctcattttatcgtccgatggtgtaatcatcaacacatcagggaaagaagttccccaaactattgacttgtaaccggtataagggagattatccttggttatattaatacccaactccacagtgccactatatggtaattctatataactgacaggtttgttgtcagtctgcccatccttgaacactacatattcaatttttatctcctcagctggtgttccatcacctccacctacgccatcatcatccttatcacacgagattgccgtaaactgtataaaaagaagtatgaaaaggttgtatactgacagaatccgtggttttatatcaaccataataaaatgttatttaagcgccaaacaaaattttcaatattcaaaaggcataagaggaaaccctgaatatgccttattaccatgaaaacaaatcaatctacctttttcaatccggaatcagaaaaatatgttatttatttagaacatatttttccgatttgccagattacaatcacaataaataaatcaacaactaaatctaattacctaatcttataactaaaccctcaaacaatgttatttaaccttttctatcttgacatcatcaagcaggaagcatccaccattacctgaacccggaacagctgtgaaacgatatacaaaaccattttcctgcaatttgaatttaactgttgtaagattgtaattcttacggtctttcttgacctcagcagtggcaatttcttccagtttctttgaatccggattatagtactcaatcctgaagttaggtttgtcaccccaactgtatttggtataagctgaaatctgatattctgctccagtttcatagctgatgtttacagcctgccacataccaaccttcacctcaacagcatagttgcctgaatgtgcctttttcgcatcaactattttgttatctttcttttcccagacattccatgatgtcaagtcacctgactcaaaatcaccgttcttaatttcctgagcgtatgcagaagtcatcatcattccgcaagccatcattgctaaaatttcttttttcattttttctaaggtttttaatttaagtattatgttgtatctattaaaatcactcttctattggaaccaacttataagccctgacccagtcataataagtagtacttttgtccttatccttcaagtcctcagctgtaggtacttgtttttcccaatcgtatgtttcagtaactatatgtatgaacataggtcggtcaaacggagtatctgtatattttgttgtaggcttgatagtgtacatatactttccgtcataatagaatttcacggtatttgcatccacccaccaacaaccgtaagtatggaaatcttctgccgatgggtccgtcatatacgaaaccacatccgaacgtttcgccgtattgtcagtacgtttgcctccttgttcctgataccaatagtgagtattactgttcatctgcatattccatgtcttgttccacggattatcagggttgacacttcttattatacccattgtttctataatatcaagttcctgactgctccatgtctttatcttcttgccgcctttcattatttccttcattaccgggcggttggaaagccaaaaagtagacgacatggtagtgagcgaagccttcatccttgtttcataatacccataatgtgcctggttctttgcagaagcaaccgctccaccggcaagacgatatttatcgcccggctttccatcaagtccttctgttggcgacaaaacggtattgattatacgaagacaacctttcttgacactaacattctctgccttgaaagttgcaggcggccgaccgttagtccaataaggacttttagcatgccatttagcggcattaagacgtttaccattgaattcatcagtataatcttcgttaactacccatttataaccctcaggagcctcaggcaaattttttatatgctcttcagccaaagaatattccttatcattttttaatgtataagatgacaggaataaagatgcagcagataaatacaatactgtttttctcataaactttgtcgttttagattttttgttacacgacaaaagtatataagtttcatgaaagcattaagggggatttacatcgtaaaaggtggggtaaaattctaccactccctgaaacacaattatttcactcatgaaaccatgtgtttttacgatatataaaacccgacagaagaataataccgtattaccggctaatttacataagaataacttttcaaaccgccatataccccactttacgtccgtaccctcagtcctcgactccggcaatatgttttccatatcgagatctatggttttctgcctcggattcaaccactaactgtcgagcatgtggattgcgtatctgtcatagaatctctttccgaaccatattatctcgtctgtgctaagtatgttgttcagacggataatctttccggtattttaccacctacttctcttgcaaatcctgatctgatataaccggatactctcaattcattgatttccgacttgtatacagtctgcgaagaggcattgaaactactgcacagactgaacagcagcaggggaataatttaactgattttaatagtagacattctgtgttcataatatttcattttaatgattacgtttctgactttcgtctgatgcaaaattatgaggtatcggacggggttgtatctttcagtaaaaatcagtaaagtcttggcaaggggtaaaaaacttaacatcttgtatataaatatattacaaacaaggtgcaaagattttcagtaaacgatggcgaatacagaacctatatatttacacgccataaaatgaagaaaaagcagtaggaaaaaaatgcgggcaagttccggataaaatgtgggcaagtttaaggtaaaacttgcccgcattttagatagaatgcgatcgcatttaaaacaagtaaaaaacgaagaaaaaaaatatgtgttcttcacagaacacatatttcaaaaataggtataaacacgctaaacaatgttaacaaaatctatttataaaaaaagctcacatcaataatatctgcaacatttttacaatactccataaatgaagagaccttgggatgatttatacacagagctatctgtgatgtaggcgaaaaacgtcctgtcccgtcaagaaacgctgtaagctcagatgggaggagtatactgccaatacctggatttacgtcagtcagaacgactgtatttacagcttccaccgctgacacatcaagataatcgagtgccggaagatctgcgaagtgcaattttcctatcatattgccgcctttgctgccctgaagagagacactctccaatgaagaacaaccggatatatggatttcactgtcgaatattgaagtttcggaaacatcatcattaagtataacagaaggaacaactaccaattgaagcgaactgttattctccaccctaagtactttcaatgatgatgcggaacttaaatccattcccaaaggtgtatcaatattagagattgaaaatactgaaactcccgaagacggcttgacatacgacatggaataatgcttggacttcactcccgaaatgtctacttttcctctgaaaccgggatttgacaatatatactccacaccctcaaggttagctgtctgcgacaggaaaatgaggtcgttcccttcggttatcctcttcgtgacatcaatctccaacgatgagacaaacaccgacgggaagtttctgtaaagatatgaacggagcaaaggatccggtactcttcggtttactgtatattcagtgtaatttccatcctcgtccgacatcacgacaagacatttgtccgtcatggctttatagaatgcaggtatgacatctgtattccattttgcaaagtaaggaagtttcagatttgtaagacttttacaaagcaccgtagtgccatcggttgaaataagattgagatacgaagttatgccgtcattgccgcgtaaagctaccgattttattccttcgggcaggtcagcaaagtcgaatatagaaaaactgttacactcaagattgacatctgcgagcgaaggaaaactcctcaaaccgctaatagatgtaagttcgcatctactcaagtccaaagaagtggtattgagaacttgattgtcacaaatcagctctccgttttcgctgaaattaaatcctttccgggtcaagacatcgcgtaactttgtatcaaaagtcacttcagacacttcaaagtcggaaatttctgtttcatccttacacgagattattgtgaaacagagaactatcagtacataaaagctaataaaattcctcataacaatcagttttgtggtaataagactatattatcaatccaagccgcgtcgttctgtctttcgcacacaatggcacacactacttttttcactgtagaattaaaatcgaaagatacggctttataattgccgggagaagaaaattcctctgtatataccgttcctgtagacatatcctgtagcatgactttcaacttacatgctccttcggtctttacatcagcagagaagcgataagtcctgccactctccatgtcaaccctctgcatgagtcctgcatgaccagatatacaggctacattattgcctgcattgtcagtctgtacgcaaaccgtaccatagttacccaatggctgccatgctgaaagtccttcgctgaaggttccattctgcaaggtagagacagtatatttctcaacctgcagtatcatggacgatacgtgacctcctccgtcggaaaaggtgatgtcgacattattatcgccattcttcagcagctgtatgtcgaacggtacttctatcataccgaaaaatatattgcggttgctctggccgtagcctttccagttgtcgggaacactcacagcggtaccattaatctttaccaccggtttcttggaagcagagacaggacggcctatcgacatacgcaagcttgctctgcccgaaccggactcgattcctgtgaaggggaacgaaagggatgatccggcggaaatcggtttcagatactcactgctgtaatatttattgcggattatggagttcgtgaatgctgacgaagacacatctgctacaaggactatggtctgatttgggacaattgagatgctttcaggcatggacgggacattctgttccgtatattctatacctgcgttataattgacatatagagaacgctttgtgacattcgatacatccttccagctattcttattgttcagatatacagtctgcgggttatcatcaagattatcaagggcgatatagagtctgcctccatccttgaatgcctgtacctgaatatcaggattactgctggttatatcaacacgttcgccttttacattcttccagagttcgaagaaatattttttgtcattaagcctccatgtggtattcttcagattctgaggattgtcgggaataaacagtgccgcactatatgaagtataattgtttgcagcggtgatatgccactcagccttatctgagacaaaaggtattgagataaacaaattgtcctgacgttccatcagattaaacagaaaatgattaaacgacgaaacactccgcacactgcttatgtcatcatagctgtcgtcgggcttgctgttgtcaatacctccaaactcggaaatggcaagaggcttgacatgtccgaacttaatataggaatacgcctcaaccatatcaagaactgcttcggagttacttcctgaacgtttcgtatcggtgccggttacatttattccatcataaagatgtacagagaatccatccatatatgcacctgcccgatcgatgaacattttcatgcgggtgttccagtaattgaagttcccatcctcccaggcggggtaggctgcggcatagcctatcaccttcatctttccgttaagacgcggattattgtgtatatgtttacctattgaagcataaaaatcgaccatcagttcgcgcatagcctgtccctgaacggtaaaaccggcatcatttgcatgaacgaacggttcattgaggggttcaaaaaactcaggtaccagctcgctgttggaataatactcagccgaccatgcacctgcagcctgaacgtctatgccgccctgtatgtgctgtacatagggatgctctgtggcaatatatctttttacggaaatatttccgctgtatggtttcatctgaggatatttgcctacctcatgcgtcttgttatacgcatacgagtatggtccccagaactttcttccaagaccgacctgatagtcggcaagaaacttgcctacatccttatcatcatcggaggtggaatgaatattgaaatatttagaacggtcgagttctgaaacaccgctcaaaaagcgacgggtattatagtcgacaaccacctcgttcctttcctgacaataaataccgggaggaacacctagggtaaatgccgataacagaaaaatatatttatagctcataatttctttccttttagacacagaaacttgtcagtcctgatgtggatacattattttctcactttcttatcgtagcgttcagtctgaagaatcatagtagccacacggcctccattatccgggaatgttactgacaccgaattttttccttttctgattaaccggtagtcgaaaggtatttctatcataccgaagaaatcgtctctgccggtctggtcatatcctctccaattgtcgggcatgtcgactttcttgccattaaccattatttcaggtttcttcgacatctcgtgcttcctgcctattgacatacgcagaacagctcttcctgtacccggtttcagaccatcgaaatcaaacacaattggttttccggcttccaccggctgaagataagtgttgctataatatttagtacgaactattctgtttgaatactttttacggatgatgtcggcacacaatattattgtctcatcttttataatgtcaatactttgaggcatcgagttcagcgtcttttcatcataaactatacctttatcgaaaatcatcttcaaagagcgcacagaaacattatctacacccttccaattcagtacgtttttcaagtttaccttatgtgtatagtcatcaagattgtcgacagctatgtaaagcctgtcatcgtccttaaaagctgccacctgtatgtccggattgtcggaaacaatatctacacgttcgcctttcacatccttccataacttgaagaaatatttcttgtcgttcagtttccatgcggtattcttcaagtcgtgaggattgttggcaacaaataaagcagctccgtatggttcgaaattatattgtttcgttatatgccattcggccttgtcagaaacaaagggtattgagatgagcatcttgtcttcgcgttcaagaagattgaacagtatatgattgaacgaagcgacagttcgtacagaggctatcggattatatcctttggaagtgttgtctattcctccatattcggttacggcaagaggaagaactttccccaagcggatgaacgagtagttttccataaggtcgagaatagcttcggaattacttcccgaacggcgggaactcttgcctactatgtttattccatcgtaaagatgtaccgacaagccatccatgtactccccggcacggtcaatgaacatcttcatagtattattccaatggtcgaaatcgcgcaactccatagccggatatgccgcggcatatccaatgattttcatttttttcagacttggctcagcgtgaatatgctttcctgtctgtgcataaaaatctgccatgagcatcctcatttcctgaccatgcatattgaaacatttgtcgcgtgcatggacaaagggttcgttaatgggttcgaaaaattcaggaactgcccctttcacatgcttggaatagtattcggcagcccatgcacccgccttcactgggtctatgccccattgtatggtacgcgcgttggcatgttccgtagcgacatatcgttttgtttccttcaaatcagtgtagttcaaaggcttttctgaaaaaggatattcgccaaccttttttgtcttgccatatgaataagagaacggtccccagaaagagcggccgattcctacaccgtaatctgcaagaaatttcctgacatctggatcagaatctttagatgtgtgtatattgaaatatttacctctgtcaagtgccgatacatcattcaggtatctctgagtggcataatccactgtgacagtagtgttataagtcttattctcggaagatgataaaggaaaaaccgagaaagacaaacacacagacaaagctgtaagaattatgttattcattgtattatcaaaatttaaaaggcagagaacactccgatagttcaattaaagtattccctgccattaagattatcacttctgtttaaacactaatatcagaaatcggccggtttgagtacatcgttcagcaccacttcatattcaacttctgttccgtcgttttcagtaacagtaagatggccgtaaccgccacttgagttattttctttcttaccttcaaacatgaacattctcttcttcgtcacttcctgttcttctttatcgcctgtttcaggattgataacttcttccttttcagtatagacttcattgaaagagaatgagagatgtttttctgtatccgaattgattttcagccactcgggcaattccgaaggagcctcagacgactcggcaaagaactcgatcttattcattctcaaagtctgatagtcattcttccaggcaatgaggtcgaacaattcgcgataaacagaaaacttggaaacctcgcctgtctttcctgtttccacattcttgagataggtaagttcatacacgggagtagaatcaagttcgacctcagcccatttgtcattatcacatgctccgaacaaaaccaaagcacataagaatgtaattgtcttataaattttatctattagcttcattgttactataatttattatggtcttacttcaatatatccgaaaaatatatcgtcaaaataaatattatccttaaaggcattaaagcgcatactgagcaatatattgtccatttcagcctttgaagtcacagtggttgtggccgacatccatttgctgtcggagccattcacaatgccgcaccatggtctatcgctctgccatgtcatatcttcagctccttctttacctgccggaacgaaatacggactcatacccttaccctgtttataccccggtgtataatatttgtagctgaaagtatatgtacctttaccaccagtaaatgtcttggagagtaatgccctgcatcggtcaaatgcttcgacaaacatacattttgcactgttgtttattccatccttcagaggattgtccacaacctgtgaaggaactacaggatgtgttttggtatcggcatcaataactttccagtcggcatatgtgtcagaattttcaaaatcttcatccaggaacgcaccaaaagtagtcgctacgtttggagctgtagcctttatctcaaggttctgatatccaaccaacgcttcagttaaagttcctgtaagggtcagttcatctgtgttatagattttctcaaccaaagtaagaatcagttcatatctgctttgcttgtttacttctgctgctgtgatgtttacgctacccctgacagctgacggtctgttatacgagttggagtaagtaagctttagagatgatggatttatctctttatatccaaactcagaattatccaaatctatagcaatgtgtgtttggtcaatctgacggatgttataagtaataggatcatcactaggtactactgtaatagccaaaggcacaacaagagtttttggcgaagcttttggagtgtacttacctttaccctcactggcagaagttctttctattgtcatggaaagaagcaatggcttatcgctgaatttctttgcagtgaactggtatggagtgtcaaaactggttaattcgtcatttacgccagtatccgcacatttgaaagtccatttgttaggcaatccgtatgaatcgtccttaatatagacagacttaccatattcaagttcgtatttttcgtattcgggagcttcctcagttccaccgactattccggtctttatttcctgtgtacactccggatcactgtatacctttacggccggtacgaggttaggatcatacacgcggatatggaaagttgtatccatcacatatacatcaccctcctgcttagcataacaatattttttgatatatcctccggtattgtcgtcatacaccgaatatggatatacaacctgtctgcggaaagtattgcacaaacgtaccgtatggtcaccgggtttagtgaaatacacatgtatggttttcaaatcgttggtatgagggatggattcatcaatcaggtttgtatagtctgtctgtccccactccatcttaccattaaggaactttgtaccatcatccgacacaacccactgatgcgacaacatgccttgggataagtccattatacttatatagttattaagattcagctgaataggtgaaacgttttcctgatctgtactcacatgccaggtacattcagccacgttattcaacggttcaaactcatcatccttacaagatgtcagaaccgagattaatgaaagagcaatatataaaaatctatttttcatcgtatttatttattaatatcaggatttgatgtaatttctatatttggaataggccagtatgccacttgcggaccgtagttcaatgatgcttggaaataatccacaaaagcgtttcctctcttttctggcggcagctcataaaatctgtactgctttccaaagttgaatgctgataccaaagcattagggtcatcaggattaggcttaagatatttggtctgaatcatacagtacttatattcgtcggatgccaactgatcaaacctttccttagttatattccagcgtctcaaatcaatgacacgtatggcatgtccttccatacacagttcaagaggacgttccacatacatcagatgattcattacatcacttgcagcatattccttctcatcgtatgtatatctcttgaattctccctgttccgattttccgataagcacaactccagcacggtgacgtaccttgttgatggcattgatagctgactgaacatttccatcgcttgcaccgcctttaatcagacattctgcatacatcagatatatatctgccaaacggataagacgatagtttattcctgaggccatagcaggcttaaattcagtttcactcttacgtgtatcccaatttgataattttctgaaatacgctgaagagccacggttgaattttgatacctgttgtgggagagactgataatatatcagactttcatcgccgtttattgcaagagaggcagatgcacgcatggaatagcttctgaggcgatatgcctgaccgtcttcccatttaaattccggaactatgtcatcgtagccggtaatcttattgtataaaactttattatctccgacagttgagacgagtcgttcgcgtactccaacatattttcctgctgttgcatcccacgtataaacgtacgttctgttatatacgacaccctgacggtccacctgcgagctgaaagttgttcccaactggtcgtatataatatccctatgttcaggatcaccataattgtcggactgcatttttatccagttacgttcatcaagtctgtccaccggctctgtttcgaatgcttcaacaagccaaaaagcaggaacagtgttaagccaggcatcgcccaagccatttacattcattccccatatattatataaggtagactccgaccatgtaccgaattctgtattatactgtgtagaataggaaacctcgagaatagattccgaattgaattcattggcagcagtaaaattatcgactatgtcatcaaccaaagcaaaacctccattatcaataatatccttaaaatattcggcagctttattatactctttatcataaaggtagcttttgcctaatattgcctttacagcccaagaggtgatacgtcccaaatcggttttctcccatttgtcattcaagccaaggtcaagagctttctgtaaatcttctctgtaatatttcttgatttcatcacttggtgtaacctttttatagtaatcttcttctacctctgcaatttcattaatataaggaacattaccattattgaatgaattattgagataaaaataaaacaagccacgcaaagaatatgcctgtgcctcaatctgagcaagcttggttatttgaggttcatctgtaacatttggacggattttctctatactggccagaacctgattcgcacggaacacaccagtatacagtgcagaccatttaccacggactgttccgtatgaatcattaaaggtttgcttataggcttcgttatcaaactgctttctgtccttattaccttcaactgctatatcacttctacggttctcatcgagcggatgataaatattggtatttttcaaagcattatatacagcagccagtcctttctcgcagtcgcctattgttttataaaaattctgtgttgtcagctgatgtatgttttcctgcgtaaggaaatcgtcgcatgaaaccaatgtcatgcccgacatcaacagactgaatactattgttttatatctgaagttcatatatttatattattaaaagttagaaattaatctggaatccgccacgcatctggatacttataggatatgttccatagtccaaaccacgacgtgacaatccattactaccgacctcagggtcgtatccgtcgtattttgtcagtgtaagaagattatcggctgcaacgtataaacggaacttgcccaatccaagctttgatacccaactcttggggaatgaatatcctaacataatatttttaagtctgacaaatgaaccgtcctcaatccacatatcagtatgagcacgatagttgttatgcccctctgtacgataagaaggaatggtagaggtatagttggtaggggtccacatgtatatcagttccttattggttcttctttgatatgtatatatcttcgtaccgtttattatttcatttccaactgaagcataccagttcatagagaaatcgaagcctctatagtcggccgagaagttcaaaccaagttcataatccggcataccactaccggcataaacacggtcgtcatcattaagaacaccatcattattggtatcgatatacataaggtcacccatacgggcacttgactgtaatttctgatattctgcaagcttctgttcagtattgattacccctgcggttggcataacaaagaaagcaccggcttcatatcctttcttgattgcagttacataatcacttcctgatgaaacaggtttaccgtcggggaagaaatataactcattttttcctgccatagacacaatctcattcacgtttttggtaaatgtaccagtcaagctgtaattaacaccacgtattttgttgcggtgagtaagtgaaaactcaacaccacggttttccatatctccggcattcaatgtaacagttgaactctggccccctccatttgacggtggcacgaccatcgggaaaagcatattcttcttgttactcttgtacaaatcaagacctaagataagcttgttattatataaagccatgtcgataccggcattaagctgctgggttgtttcccatttcacattcggattggcaaatcccaattgggtaaaaccatttgcaagaatttcggaagttccggtaccaaaagtatagtcgtagtttttgtatatagctggtgcgtatgaataatcagggaagttctgattaccggtagtaccatagctgaatcttaattttaacgaatttactagccacctgaatctgtcgaagaatgattcctcagaaatattccatcctacagacaatgacgggaacaatccccaacgattttcttcggagaacttagatgaaccgtcgcgcctgatactggcacttgccatgtatttgtctgcatagctatattgtagacgacccaacataccaaccattgtactgatacggtcctgtccccactggccactgcctgtacccacagtcatatcggatgttcccgcatttaggttcggaatctcgttagtaaccaaatccattatactggcatagaacatctcgtatgtatatttctccatactgaaaactccggtaaatttaatatcatgcttttttatcttcttattataatttaccattgtttcccaagtgagactggtattctttgaatgagtatcttttaattgcgaacggtaattagagctggttaccttttcgcctttctgattatatacctcaaactcaggtcgaattgagacagctttctgattgttatatccaaagcccaaacgtgtggaaacattcagtccgggaattacattataagcaagataaaaattaccgttaaatgattctgtgtccttatgattttcctctttcaatcttcccaatgtataacttacgccctgtaaatctgcaggatcgccagctgcatttactatacttgcctgtggataaatctgagaacgagtaggcgagtagtcataacattcgttcaataacccccaagccggagataactggttttctatcttcatagcgatgttagtgttgatagtccattttccgcgctgaaaatgtgtattcgaacgaatattatatcttttgtaatcggaatttatcaacacacctttctggtcgaaatagttcgcggtaaggttatatgtcaaatctttcttgccgccattcgcagtaacagaataattctgtattggtgcgttattattgactacatattcatataaactagagttgttgaagaaattcacaggatatgttttcagattagaccaggccaggtcgtctgtattctggtttccttccatcattctgttagacatcacttttacaaatatactctcgttggcatcaagcaaatgaatattcgaagtaatgtgctgtacaccataatatccgtcgacagctatcttcatttctccttccttacccttctttgtggtaataaggataacaccggaagcaccgcgagtaccataaatggcagccgaagcagcatccttaagaatatctatacttgctatttcgctactactcaatcccgggtcgccctcgaacgggacaccatcgacaacatataaaggagaactgtcgcctgagatagaacttaaaccacgaatctggatgttggatttggctccaggctcaccagaacttgcctgaacgttaactccggcaaccataccctgaagagctgtacccaagtcggaagtactgatcttagtaatctcatctgagtttacacgtgccactgcacctgtcacctcttttttacgcattgagccataacctacaacaaccacttcatccaacacttttgtgtcttcctgaagcttgatattataaatctgaccattcttgattgcagcttttacagttttatacccaacaaaactgaacactaagttacctttagtcggtaccccttgaagaacgaaattaccatccatatcagtaatagttccaagagaagtaccttcaacttgaacagctgcgcctataacttcaaggttattggcagcatcaatcacctttcctttaactgttatcttctgtgaatacatagacaatgtatagaagataagcatcacgaacaacatgtacctgccatggtaccattttttctgatttctcatttgtaaaaattttaatttagcaataggttatgaaattccttttataactgacgctaaattatttatttataatggtacaaaaggggagaattatatatttaaaaagggggtaaaattttacccccacttatattaagaatccaaatcggtctgtatactctgttctttgtactgttgcggcaatacaccgaattctttcttgaaacattctctgaaatacttcaaatcattgaaccctacatcgtatgtcacctctgatacagaataccgtcctgtcttcaacagttctgccgctctcttcattcttattgaacgtacaaaagcattggctgttactcccataagtgctttcagcttcttgttcagaaccaaggccgtcacgccaagacctttacatatatcctctatctggaacgaagagtctgtaatgttgtcctctattatctttacaagtttctcaaggaacttatcgtcggtagatgtagtgcttacctcggaaatctttattgccggaactttcttgtgttgaagaatccgcttcctgttggttataatggaattaagcagctctttcattatcttgttgtcgaaaggtttagggcaataagcatctgcatggaatttatatccgatgaaataatcctgcaatgtagtcttggctgaaagcaatactacaggaatatgagatgtccttacatcctgcttgattctctcacacagttccagaccattcatgcccggcatcattatatcggataaaacaagatccggttgcaaatctggaatcatgttccatgccatctccccatcatgggctatcattatcttatacttatccgacaacagtaatgacaacatattacatatatccttattgtcatcaacaatcaatatagccggagattctccgtccacttctatgtctatcatctcttcatgctcgcacgattcacttcttaacacatcagcaaacttttcatcctccccactgttggcagagatattctccgtaaccatgtccccctcagttatcataggaattacaacatggaaaacagtgcctttaccttcctctgatacaaacgtaatatttccattatgtatctctacaagccgcttggtcagaaacagacctataccggtacctccttcagcagagtttttattctgactgtagaaacgctcgaagaggtgtgttttcaggttgtcggatattccgtttcccgagtctgccacagagatgtttattttgttatcctgttcattgacagtaaacgatacaaatcctccggcaggagtatgcttaatggcattcgatacgagattatagattatctgttccataagatgagggtcgaacagaaagcttatatcactgcgtgagacagaatattccagccctacacctttctgttttgcccaatacgtgaactgctgaaatacttcttttgagaaagacgagaagttgccatatttgagattcagactaagcattcctttctcgctctttgagaagttcatcagctggttgacaagacttaacaggaacttactgttatgctccattgtctgcagcatgccggcaagatacttgtcggacgaatacttgcccgattcaataatcatactaagtggagaatgaataagtgtgagtggtgtcctcaattcatgcgatatgttggtaaaaaatgtagtctccttttcaagaagttcttcagtcttgcgtttttccatgtttgctatatatagagcatttctgcgctgcacccgtgaggtataatacaccttgaaccggtataaagacaagacaagcaatataaaatagagtgtataggcataccatgtacgccagaaaggagggttaataatgacaggtatggaaagttcattcaaactgtagactccatcgctattcctgaccctcagtctgaacatatattcgcctgaaggaagctttgtgtagaaagcctcacgatgaaaagcggaggtggaaatccatgaatcatctacgccttcgagcatatattcgtaaccaaccttataaggacttctgtaatccagggagctgaactggaatgagaaagtgtttaaattataaggcaattcaatgtgctctgtaaaacttacacttttgtcgaaataagctgaatatgtggaatctgcctcaacgctgtgattgaagattttaaaatcaacgagtgtaggactaccgttgaaatctatcacatcaaagtcattaggtctaaagacgttaattccgtttacgccaccgaatatcattgttccatccgtcattactccagcagaaagttccataaattcataatcctgaagaccatcgaaaatatcataagatcttattctctgtgtgttgatattcaacgaattaattcctttattggtagaaatccataatgttccatccgtgccattaacaattgattttattgtattgctgctcaacccgtctgcagagctaaaattttcaacgcaggcattatggttttcatccaaatccacgattttccttaacccacgtccaagtgttccataccagatattatgattcaagtcttcacatacaggcactatatagtcgagttcatcaagtcccttgactgagttcaaaacaggattatctatatacaaatctgcagattccaatactttaagaccgaagctggaagctacccatatattacccttatgatctttaatgatgtttcttactatcttaagttctttattgtcagatgttttgatttccttcatcacacctgtggacaaatcatatctgaaaagacctttattatatgtgccaatccacaaatattttccatcggcaagcattgcgcgcacatttctcaaacctgagatctttttataatcattatcagaagtgaaactgtaaataccatcgtacatcagagacacatacatgcagtcggtgtagtttgagtatgctgttgagtatactatcctgtttgccgtgaaaggaataagtctggcattaccggtaatggaattaaaatgatatagccctgagccttctgtgcctaaatatatatcagatttggcaaatgtataaacggacgatatatgatcatttcctattcctctgaataaatctataggtttattattttcgcgtatactcataaagccactcttgaaaaatcctatccaaagaatatcgtttttatcaagaactacagtttgcggatagctgtaagaatatgtagcaataacctgtggttttgactcgatggcatgcaatacatcaaaagtcaacacattcacagtgcttgtagtggcataaaataatcttttgtttttatataccatttttcgtatatcacagttttccaacagggtacttaccttgcaggtatgcttgtcgtataaacataattgatgattttccagatttgagtacaatatttgagaagatgagatgactatggctgaagctatagggcatcccaatagtttgttaagcagtaattcatctccatcgacgttacattcgtacaggccgtcttcggaggagagcattatcgtattatctatttctatgatgtcggaaatgtatggtaattttaatgttgatcttaagacagtatttattttgccattttgaaaatcataatttacaaggtatatactttcatcagaggaatgaaaccagactctgtctttagagtcgacaagaatcttatcgcaagtgaaatttttatcaataccgctgtgaccaagatttaatgaaacgaattcgttctttacagaattgaacaggaacactcctctatcggctgtacctatccacagatttccatgtgaatcttcgtcaatacatactatcagattactgttaagaccgtttgactgatatccgtaaaccttaaattcatatccgtcaaacctgttcagtccgtcgttcgtggccaaccatataaagccttttgagtcttgataaatacattgcacatcattttgggaaagtccatcaagagtagtgtactttcttgtgacaaactcattggatgcaaaggatttgcaaactataatcagaactgatattaaacttaagattaatctaaacatataactattattctttatatttcatcaagattacaaagttattgattttatctaaaacatcaagtatttacagtagttaatagataattatagatattttccactttagaatgcgtatcaaaatcaatcaagaaaaaaataaatctttaacttcatttcatagtataaaacaaaaaaagcatcgtaccattacactcaataatagatacgatgcccgaaagaaattacagtaacagactgtattgggattgttcttaaaaagacttatctgtatgactttatatatatgtcgagtatttcggtatccgacagttcatgagggtccagactgaacaatgcacccatggcagttcgcgcattatcaatcatcttagggaaatcttcctttactattccccagtcgctaagcttcaaatcgcggacattgcattccttctgcattctcaccaaagcatctataaaatgttcgggattaaggttcttgcatccggtcataacatctgccatgcgcatatatctctttgtcctgtcataaataaaagtagagaaataggcctcgcttatagctatcaggccaacaccatgaggaagagcgggatagtatgcgctgagagcgtgctcgagagaatgttcggaagtacaactggatgtggattcaaccattcccgccagcgtacttgcccaagccacctttgccctcgctttcaggttatttccatccttcaccgcaacaggtaaatatttatacagcagtctgatggcctcaagagcgaaaatatcacttattggggttgcacaattggcaatatagccttcggctgcatgaaagaatgcgtcgaatccctgataggcagtcagatgtggcggaactgaaaccatcagttccgggtcgattatcgacagacatgggaaagttaaagtggagccgatacctatcttttcgtttgtttccagattggttatgacagtccatgggtcagcctcggttccggttccggctgttgtaggaatggctatgatgggcaatgctttgctgtaaggaagccccttgccggtacctccttcaacatattcccaataatcgccatcattacatgccatgattgcaatggatttggccgtatctatcgaacttccgcctcccaaacctataatcatatcgcaattttcctcacgacagattgccgtaccttccattacatggtcttttattgggttaggcaatatcttgtcgtacaccacggcatcaacattattttctttcagcagaccaatcaccttatccagataaccatatttacgcattgatgttccggatgaaatgactatcaaagcctttttgccgggcaatgtctctgttgaaagacgtttaagttcgccacatccgaagagaatcttcgtcggaatattataaccaaaaacaaaattattgtccataaatattatcagtcagtcaacttactatcttaaagcctcatcaatcactttcttgagttcaggataagcctcatctgtatcgcccacctgttttctcaactcacgcagtttctttttcatgtccttaagaactttggcgtatttaggattatcagccaggtttaccatttcgtaagggtcgttcttcacatcgtagagttcgaaagaaaccggagtaggaacaatcttgtggctgttcttcaaccatgacattgatttctgtccgtaacgtttgtcgtcgtaatgacggccatagaaaagtatcagcttatagttttccgtgcggatacctatgtgtgccggaacgtcgtgatgaatcatgtgcatccagtatctgtagtaaacagcatccttccagttttctggctttttgccttcgaacacagaggcaaagctctttccatccatgtatgaaggttctttgccaccgaccatctctataagagttggagcaaaatcaatgttgttaatcatcaggtccgacttggctcccttgtaaggacatctcgggtcgcggactatgaaaggcattctttgagattcttcatacatccatctcttatcctgcagatcgtgttcgccaagcatcataccctggtcgcctgtatatacgataatggtattttcccagagtccttccttcttgagatagtcgaaaagacgtttcaggttgtcatccacaccctttacgcaacgcagatacgatttcaggtaatgctggtaggcaaggtatgtattctccatttcatcacctgtattgcacttatattccattacataattgcggatttcatgacggcttgagacagaagttccgatgaagtgacgaagtgaatcgttcttgcctcttgtgccttcggagccccatttgtctgtatcgaacaatgacaatggaacaggcacttccacatcgtcaagataatattcatagcgcggtgcgtactcgaacatatcgtgcggtgccttgtaatgatgcatcatgaagaaaggtttggacttgtcgcgtctgttcttcaaccagtcaatagcaaggttggtcacgatatccgaggagtaacccattttctttatctggttattaggccatttcttgtcagttacgtcacttgtaaggaaaatagggtcgaagtattcgccctgtccgccatgaccgttgaatacagaataatagtcgaagtgcgacggttcgcatcccaaatgccatttaccgatcatggcagtctgatatcccatattatggaactcatcaaccagatattcctggtccggctgaagcacttcatccaaagtgagcaccttgttacgatgggaatactgtccggtcatgatacatgcacggcttggggtactgatggagtttgtacagaaacagttctcgaagagcataccgtcccttgccagttcatcaattgtaggagtagggttcagtactgcaagacgacttccgtatgcgccgatagcctgcgaagtatggtcgtccgacatgatgtagatgacattcatctgtttctgctgtgctgcgacaccaacacatacagacaggaatggcataacagccattcccttcattatattattttttaaattcgttttcataagtcagattatcattgaaatagaacttgcaagacatatcatcgaatgattttacgtccttattctgcattttaacccattgttctgatttagccttgacagcgacctgagttgaaacctcattaccgtcgactacacttttaagagtgacatttgcatcctctgcattatggtttgccacacgtacagtgataaggcatccgttatcaaccttatcgtatagcggtttggaaaccaccgcccctttaagcttaatcttgaacacatgtgcatattcagtaggtttgttcttagggaagtttactacaagaccctcgtcagtcatcttatagtcaatcttctctgagcttccaagcatttcaaccgactcaatttccacgttctggcaatacttaggagcaaatgacttgatagtaacactaccatctgtccaagccagagacacggcatagaggttattgtcgcgtgtagtaaagcgaatgtcgtccgctgtatattcagtttttgtattgtctgtcatataacctgcggtgcctgcgttatgtccttcgaaagcaatcacccatggtcgtgagccataaatagcctcaccgttagtcttcaaccatttacctatctcggcaagtacgttcttctgttcgtctgtaatagtaccgtcggccttaggacctatattcagcaataagttaccgttcttgctgacaatatcaacaaagtcgtcgatgatatggtcaggactcttgttttcctcgcccacacaatagctccacgatttcttgcctacagaagtatcagtctgccatggatattcacggattctgtcgctcttacctctttctatatcgaacacctggatattgtcgccatatccgaatttagtgttaaccacaacttctttattccaatcaagagccgaattgtaataataagccatgaatttatagaaagtaggctggaacggatattttcccacagtccagtcgaaccatatcaattcaggctgatatttgtcgataagctcgtatgtatgcataaggaactgacggcgtgaacgttcgttcgagccttcatacttaccacaataaggtgtcataccctgaccttcgggctcatgcagtctttcgccatacagagtgattgtagtgtcctgaacatcagaaggagtttccattccatattcatagaaccatgcattctcgcatctgtgagaagaaagtccgaaacgcagaccggctttcttggtagcttccttcaattcgccgattatatcccttttcggtcccatatccacagcattccacttattgaaagtactgctgtacatggcaaatccgtcgtgatgctcggccaccggaacaatgtattgtgctccagatgattttaccactgccagccactcgtcggcattgaaattttcggctttgaacatagggatgaaatccttatatccgaatttggtcaaaggaccgtaagtctgtacgtgatacttattaataggatgaccttccttgtacatccagcgggaataccattcactgccgtatgcaggaacggaataaactccccagtggataaagataccgaacttggcatccttaaaccattcaggaatagtgtaattttgagcaatcgatgccgaatcggccttgaacacatcagtaccttttaaagatacagtagaatctacattaggagcgtatgtagaattgcacgacgccaacaggcttaatgccgcaactcctaaaaccgttttcatggatttcttattcataataatcttattacattaaataatgacattaattttttctgtaagcaaagatacacttgagttccatttacaataaataatttaattactatagtaaggggtaaaatatttaccacctattattgaacaaatttaccccctctcatatatgataataaactgccaatatcgaattacaagtaaatatatatttcaacaaaaaaggtttagcctattattacacaacaatttcaccctaagaataaaatatatatagagtaaatttgccaatataacaaactgtaaaaacaaatttatgaaaaactatttgatttacttactcgcagcagtatcgtgtacaactgtagcagacctaaatgctcaagtcagtacaaaaacaggtaatgaaaccacagaacttacaattccgaaaaagttctacaaggacagcattgatttcagcaatgctccgaaaagacttaacaacaagtaccctctttccgaccagaagaacgaaggcggatgggttctaaacaaaaaggcctctgacgagttcaaaggaaagaagctgaatgaggaaagatggttcccgaacaaccctaaatggaaaggaagacaacctactttctttgcaaaggagaatactacatttgaagacggctgttgcgtgatgagaacttacaagccagcaggatcactgcccgaaggatatactcacactgccggtttcctggtaagcaaagaacttttcctttacggatatttcgaagcaagactgagaccaaacgactcgccatgggttttcggtttctggatgtcgaacaatgaaagaaactggtggactgaaatagacatttgcgagaactgccccggcaatcctgccaacagacatgacctgaactcgaacgtgcatgtatttaaagctccagcagataagggtgatataaagaaacatatcaacttccctgccaaatactatataccattcgaattgcagaaagactttcacgtatggggacttgactggagcaaggaatatatccgactatatatagacggagtactgtacagagaaatagagaacaagtactggcaccagccattacgcatcaatcttaacaacgaatcgaacaaatggttcggagccttgccggacgacaacaatatggattctgaatatctgatagattatgtaagggtgtggtacaagaaataagaaataacataatctgaaattataaaaggcagtcttcattatcagtatgctgatgataaagtctgcctttttaacaagaagataaagattttaatctgccctatcactcatttacttcatccggatactctgtaagcgagtttcccgaattgcttatttcaatagagccgataggaagataattgaacttcttgctccatgcagagataccataatctcttctaagaataggcatcatgacctcctcggcacgtcctgagcggacgaggtcaaaccatctgtcaccctcgcatgccagttcacaacgacgctcataccatagaacatcaattacgcttttaaatctgtcaggatacatctgcattagcttgtcaacatcaatataacttccgtcgtctgcatgaacatgcttctttctgagttcatttatgtaatacttcgcttttgcttcatcaggattagtacctctgagatatgcttcggcaagcatcagatacacttcaccatatctgatgacccttacgtttccaggcttgtttagattggggtttcctatcatatcgtaatttttgaaaggaggatatttcttctgggcatatccctggaaatcaggcccgtaagagcctgtctcccaaacaactttttttgattcatcctgaatattggcattaggtttggttacaagttcatcgtaagtaaatatcgccgcatcacgacgcacatggtcatccggaaggaaataatcatacaattccttagtaggcagacaaaagccatatccattatcataatcaggactatttttcaactgtctcggtccgcagaaagtcacccacatagcaccttcgcctgcatcaatattaccccagtttgtattaccagatttggtagaggtctgtatttcaaatatagattcctcgttattctcctgatgagccgcaaacaatttagaataatcatccgtcagagtataattaccacttgaaattacatcctccaataaaggtttcgctttgtcaaaaatcttagcatcatcgttgctccagtcagcccaataaagatagaccttggccaacagggcttgagccgcagtcttggtaatacgtcctttcattgtgtccgggaaattatcctttagagaagggatagcttcaagaagatctttctctattgctttatttacattttcgcgagtatctctcgtaaacttgaatccttcaggataaagagtctcaagactgataaagcatggaccataatatctcaacaattcaaaatgataccaagcacgtaagaacttagcttcagctttataaactttagcttccggactgtcatactctgaatttattacaagattacatctatatataccacggtaacgagttttccacaaattatcggaaatagaattgacactcgtatttgaataatcctctatagcctgcatgtaaggctgatcctgatcagagccaccaccagtacgagcattatccgaacggatttcacccataggtacaatggaagcaagtgcattacccgaagcaccacctatgtgagctaacggatcataacaagcagtaagcgctttgaacatctgttcatcggtcctataaaaagaactttctgtttcggacattataggagctgtatccaggaaactgtcgctgcaagatgatgatgcaatagcagcaaacatgaggacaagaatattattatgtattttcgacttcataattttcaattttagaaattaagacttaaaccaaatctgaatgtacgggcctgagggtaagtaccatagtcaatacctgtgctaagaatattgccacctgccatatttcctacttcaggatccataaacggatagctggtgaaagtggcaagattatcaattgctgcataaattcttgctttattcagcatcaacttgtttattaatttagttgggaatgaatagcctacctcaagtgaagaaatctttaaatgcgaaccatcataaagataaaaatcggatggtttgccaaagtttccattaggatctttggatgaaagacgaggcactccattatcatcaccttctttccgccatctgtcaagatagaatgatggaaggttgctgcgtccgtatgcttcctgtcggtaaatatcagagaagactttatatccagcttttcctgttaagaagattgtcatatcaatacctctccagtcggcacctaaattcaaaccgaatgtccattttggccaaggattgccacaatcggttctatcttcatctgtaatctgcccatcgttatttgtatcttgccatataaagtcacccggaacggcatcaggttgtatcactttaccgtcttttgatttatagttctgtatctgctcttcattttggaatattcctaagttcttataaaggcggaaataacccatagcatgaccttcctccatacgcgttacattaacagatgttctccagctaccaccatcagtatatccatttacatttcctatctttacaacctcatttttaagatatgaggcatttgcggaaatagagaagttgatttcgttccaatttttattaaatgtcatctgcatttccacaccctggtttgttatattaccaaggtttctaaaagctgcattattacctctaatggcttcaactgttggctggaacaacaaatccttagtactttttttaaaccagtcgaaacttgctctaatcataccattatagaatgtcatatcggcaccaacattaaattgttcagaagtttcccatttcacgtctggattaacaaggttattaggagcagatcccacagtgatggcattaccaaacgtgtaattataattattgccaataatagaagtataggagaatggagaaattcgctcatttccgttctgtccccaagagaatctaagtttgaagacatcaaagttcttaattttccagaatttctcatttgaaacattccaacctaatgaaacgcccgggaaagtagcatatctgttattgggaccgaaatttgaagacccatcgcgtctgaccacaacttccgccatatatttttcagcataattatagcttagacgagcaaaatatgagaacatactatgtctaggattagcaccgccactattagctgatgtcataacatcaccagcattaagataccagtaattctcattggtcattgcttcatttggatatttatttcgtgttccggccataaactcataaacatctcttgatgcagaagtacctaacaggacagatgtagaatgttcaccaaaagattttttatatcgcaatgtattctcccactgccaactactattagcatttgtactttgttctaccctagaattatcttctttacattctgcagaatgaaaaaactttggtgcaaacattcttccacggaaattccgatgattaataccaaaatctgtgcggaaaacaaggtctttaataaaagtgatctcagcataaacattaccaaaaaattgctgggtaatatttttattcttaggtgcctcatccataaatgcaatagggttccacatacggctataaggtacaggagagactccatatccgaaagtatcgttgctattctcatcataaaccggagtagtaggatcaatattataggcgtatgatatcggattataaccattgataccggttgccactccactattctctatatatgcatagttgacgtttgcacctacacttaagaaatcatttatagaataggaactgttcagccttgtgctgaatcgtttgtaaaatgacgcatcttcaccgataataccattctggtctagataattcaatgaaagcaagcttgaacccttatcactgccaaagttagcagtaatgttatgctcagtaacaggagctgtattcaatatttcattaaaccagtctgtattataacctgttggagcagtaggtacaccaccggcaagcggcatatcatcattgtcggcaaactctttcatcagcataatgtactgttcatcattcagcatggttggtttctttgctactgtagagaaaccatagtaaccatcataagcaagcgatgtctttcctttctttcctttctttgtggttataaggactacaccattagcggctctggcaccataaatagcagctgaagttgcatccttcaagacttccatgctttcaatgtcgttgggatttacactgttcatgtcgtccataggcagtccgtcaattacaaaaagaggattagagtttccatttgtaccaacaccacgaattaccagcttcggtgctgttcctggctgaccggaatttgtcacaacgttcacaccactaaccctaccgctcaatgcattcacggcatttgctggtttagattgcaataaatcatcggaatcgatgctactgatagcacctgttacaacactttttttcttaacctcatatcctattgctacaacttcctcgagtgcaatggcagatgtttttaattgaacgtctatcttagactgacctttatacactatattctgtgtatcatatcctacgaagctataaatcaatgtcgattccattggtacattttccaagatataatttccgtccaaatcagaaataataccgtttgtggtacctttaactaaaatacttgcacctatcacaggtaaaccatcggagtctgttatacaaccggtaactttcccgttctgtgcatttaatggtaaactgaacgttataagaatcagcatacacattaatgatagtgttctgttcataatctagagttttttgtaattagtgtttttcttaaaataaaaagttttgttctatcagttgcgcgctacttactgacacttgcaaatatatatactatgtaatataaccaaagggggaaaatttcatttaaataggggggggaaatagattaactaaatattttaaggaaaaatggctgttagaatccattcccagactccaacagccattttatcactaacaatcgcctgttaatcaatatatttttctgcccatttccttaagatttgcatccctgcccagtggaacaaaagtaaatccgtatgaatagcttcccttcagaagacgcttgtctattgaaggacgggctttcagactccagctatctgttccgcccactccagcctgaaccaggtcgatattaagagtattagaatacaagtccttttcaagttcatttatatgtttagccttatcaatcgcattctgcgacatctcccacactgaaacagataggggttcatcgccgacaatcatcacacctgccttatccgactgcaaggcaaaccatctcacgtcacaacggtttccgttttcctgcggcattacatagtcaaatcccagagcggacaccttgcagttatatatagacaccattgcagaggcttttctgtcggaatagttttcccatgggccacgtccataatatgtcacatccgacaaacgattggtacattcgcattgcaatcctacgcgcaacatttctgatatttcaggagacttcatcattgaataatgaacgcctattgttccgtctgcttttactttataattcaaggtaagtctcagtctttcatctatagcctttagcaccttaacctcaagattgccttccgatttgcgtacatctatagaaactgtctttagctttaatggagcatctttccagaatgcaaacagtctatcgaccttccatcctcgccagtcattgtctgttgacgctctccagaagtttggtttcagagcagatgtgatgatactttcattatctatcttatactgactgatataaccatcactgatattcagataaaagttctttcccttcacgctgatgtctttcttgttatctgaatcgatttccatatccaatgtagtatcaacgcattctactatctttggtaaagaaagatacttaaactgttcccaggcaacctcgtatccagctttggcatacagattgtcattcttgagcctggcactcaggaataaccaatattccgcaccgtcatcggccttgaaattctgaataggaagttttagtttacagctctcaccagctggtgttgtcggcacaataatctcaccttcctgcaatacactgtcttcgtccttcaattgccaaaaataacgatactcatctgttgaaaggaagaagtttctgttttttacagttatctctccactatagacattatcagttgtaaatgatacaggagcaaacacgtacttgcattcctcagtagcaggtttaatggagcggtcggcactgataacaccatttatacagaagttttggtcgttgtgctcccctttctcatagtcaccaccataattccatgatttcttattatatttccgttcattatccagcaatccctggtctatccagtcccaaatatatccgccggcaagcgcatcatgagaacgtattgcatcccagtattctttcagcccgccggtagagtttcccatagaatgtgcatattcacacattattatcggacggttcatgaccggattcttagtcattgctataagctcatcgaccataggatacatacggctaatgacatcgacgtataaaggatcatcgggattggcatacacacaaagctctttctttgccggtttgacatcttcgttcacattaaaatctatctcactagtaacgattgacgcttccttacgtccgataggtttgtataaaggattttccggctgtccttgcgccccctcgtaatgaacaggacgggttgggtcataatctttcagccatcctgacagagctgcatgattagggccgcatccagactcgttgcccaacgaccacataaacacagaaggatggttcctgtctctcacagccattcttaccactctctccatgaacgagttagcccactcaggcctattggacagataccccctttgatgatgagtttcaagattagcctcatccattacgtatataccatacttatcgcacagttcatagaaataagggtcgttaggatagtgcgatgtacggactgtattgaagttataacgcttcataagcagaacgtcttcgagcatctcatcacgtgtaacggtcttacctccggtctcgctatggtcatggcggtttacaccaatgagtttaataggagtgtcattcaccagaatctgattacctgttattttaatatccctgaaccctaccttattacttctcgcatccaccacgttgccctttttgtctgtgagctttataaccaaagtgtatagataagggtgttccgaattccatagttttggcttagaaacaattccctccatcattccgtaataaacattatcacgctgaggataaggttcgttcaccacataatcggcagtaacggtaatgtcttttccaaacaccggtttcccatcggcatcatataattgggctgacagattccatcccttcaaatcatccatattctgatttgttatttccggacggatctgtaaccgtgctatattcttccggaaatcgatgcgtgtccttactccataatcatatattgccacctgcggaatggacatgatatatacttcacgatggataccagccattcgccagtggtcggcatcttccatataacttccgtcggtccacttatacacttgcaccgccagtttattctcccccttcttaacgtattcggtaatatcaaattcagtaggcagacaactgtcttcggaatatcccaccttctgtccgtttatccatacattaaatcccgaatagacgcctccgaaatggagtataatcctgtcgctcttccacttgtcaggaacaacaaactccttgatataacaccccgtctgattattcctgtcaatatatggcggacgagcagggaaaggataaatagtatttgtatatataggatagccatatccctgcatctcccaacatgaaggaacaggaatagttttccatgatgatgaattgtactccactttataaaaaccggcgggagccaatgccatatcctcggaaaagttaaacttccattggccgttcaacgacatatactccgatttctctctgtctccatccaaagcccaatccactctccggaaagaataagtagtactgcgggaaggcaaacggttaattccgtttatggtctgatcctgccatacattctgattgtttctccactgattggcaccgttgtccgatgcagacagaaattgcatcatgaaaaataacacagaaaatgaaaaaatagattttaagttcaagttcataaattcgcattttaagtttctatgcaaatatataagtataacgaacaatgaatagggggtatttctatctatatagagtggtatttttacatatgagctaaaacttaaaaaaaactgtcagtattactatgctatgtagcactctatatgaaaatattatatattcccaagtcaaaagccttttcaaacaatttttatatattctcatcctatcccttccatcaaagataaattccaatcctgatttgccagccgcatttattccttttttcaggagaattttctttatggctatcgccatgaaaattcacctgaaaaagaatgcggcggcaaacggattagaattaaagaaaagattacagggattaactgcgaccgacgtgacgcatagccgtaattcaaaggcggctatccttatattccatatatgacctcacaaatactgtgaaaatccactttccccaataacaaaacatagcctgccatatcaacacccaaaa

SEQ ID NO: 67 - DNA, 78665 bp, Artificial Sequence
  Synthetic sequence
taaggattgattcgctagctcagcaggtagagcacaacacttttaatgttggggtcctgggttcgagccccaggcggatcactgaaacaaaaagcaaaacaatgaaaaccgctgataatcaatcattatcagcggtttttctttttatccatactgcaaattgaagcagaataccgcattttactggaggtgaaataggtggacttaatttccacataaaaacaagtccacctgattggattatatttcactgattctctgcgttttgcataaaacaaactcttttcaaaacatgtatttttacaccatcaaaaaaagaagagtatggcaatgcaaagaaactattttacggtattgtttttcctgaagaaatcaaagctgcttaaaaatggagaagcaccaatctgtatgcgtatcacaataaacggaaaacgtgcagaggtacaaatcaagcgaagtatagatgttacaaaatggaatacgcaaaaagaatgcgcgattggcagggaaaagaagtatcaagaaataaaccactatcttgatacgataagaactaaaatccttcaaattcaccgtgaacttgagcaggacggtaaacctattacagcagatattataaaaaatatctattatggagaacactctactcccaaaatgctgcttgaagtattccaggaacacaattcggaatatcgggaattaatgaacaaggaatatgccgaaggtactgtacttcgatacgaacgtacagcaagatatttgaaggagtttatcagtgaacaatataaactggctgatattccattaaaatcaatcaactatgaatttataaccaaattcgaacatttcattaaaatacagaaaaactgtgcgcaaaatgcgacagtgaaatatctgaaaaatttaaagaaaatcatcaaaactgcattgataaagaagtggataactgatgatccgtttgcagaaatacacttcaaacagaccaagtgtaaccgtgaattcttaaacgaaatggaacttcgcaaaatcatcaataaagattttgatattcaacgattacaaaccgtaagggacatattcatcttctgttgtttcaccggtttggctttcacagacgtaaagaatctgaaaaaggaacaccttgtacaggctgataatggtgaatggtggataagaaaagcaagggaaaagaccgataatatgtgcgacattccattgttggatataccaagacttattttagagaaatatcagtcaaatccaatctgcaatgaaaaaggattattacttcctgttcccagcaaccaacgaatgaacagttatttgaaagaaatagctgatgtatgtggtattcagaagaatctttccacacatattgcaagacatacatttgcatcactggctattgcaaataaggtttccttggaatccattgccaaaatgttaggacacacggacattcgtacaactcgtatttatgccaaaataatgaattctaccattgccaatgaaatgaaagtactgcaaaacaagttcgcaatataattttcaaccattatttcatttcttacagcaaatatcgcactttgccactgactgtgcaaggcggccctgtcgggctggttggcggaaaaaaatcatcctcgcttcgctccggtatttttttccgccaagccttgcaccggtcattggcaaagaacagccgggccagtaagaaattgaaatactggctccacggagccggtcatgtctaatttaaataaaagaatatgactgaagaagttggaaagaaggtatgtgaaggtacagtagcagacctcatgaaggacaagaccggaaaacagacggttgtcacgttgacaagaaagaatgcttaccgagtgaagaaaatcagagaacaagggacggatgacgaagctgtcctttttcatttccgtgaacgctgtacgggaatgggctcctatgtacacacaatcgaagcggcagacggagaaacagaacttcatccgtctgaatttgaaaaatgggaagctgtggaattcctgtatcccggctatctggaagacctgcttgatgctgcatacaacgcatacagatggagttccttcgaacctgaagcaagggcggaaacagacatcatgcaatatgaaaaacaacttgtagaggatctgaaacagattccggaagaaaaacagaacgagtataccagtgcataccatagcaagttctctgccttgctgggctgtctctcacgatgtgccagtccgatggtgacagggcctgccaaattcaactgccagcgcaacaacaaagccttggatgcataccagaacagatttgatgaatttcatgattggcgtaaccgcttcaaggctgccatggaaaggatgaaagaggctgccaaaccggaagaacagaagcaagaggaggcatggaaccgcctgaagcgtgacattgcaagcagcgcacagaccattcatgatattgataccggtaaagcaagaggatacagccgtgccttgtttgtcagcagtatccttaataaagtaagcacctatgcaggaaaaggagaagtggaaatcgtacagaaagcggtggacttcattacagacttcaatgcacaatgcaaaaaaccggttatcactccgcggaaccgtttcttccaactgccggaaatggcacgccaggccagactgaaacttcaggaaatcagagaacgggaaaaccgtgaactgaaatttgaaggcggaacgctggtatggaactatgaggcagaccgcctgcaaatccagtttgacaatattccggatgaccagaggcgcaaggaactgaaatcatacggtttcaaatggtcgccgagataccaggcatggcaacggcaacttacacagaatgccgtatatgcagtcaaaagagtgttgaaccttcaaaacctataagacatgaaagaccgattgaaatatgtaatcgattcccgctacttcgacggaacatgcctgacaagtatgagtgacggattccataatgactatggtggggaaacaatcgaagaactgcgcatacgggaaaacaatccctatctgaaagcagtaacaccttctgatatagacaagaagctgcggctatacaatcagtccctgtccgaaccgttcaaggaaatcactgaagaagaatactatgacctgctggatgtactgccacccttgcgcatgagacaaaactcgttctttgtaggagaaccgtattacggaaatatgtactctttctgctttactcgtcaaggaagatatttcaagggcctacgctccgtacttactccgcaatccgaactggacagtcagatagaccgtcacatggaaatcatcaaccggaaagccgtgatctcaaaagaggaaacaagtaaaacggtcacaaccggaaccagactcattccctattatttttcactggacggaaaacagcccgtattcatctgcaaccttgtcatccaatcagattccagtcaagcaaggacggacatggcgaataccctgaaaagtcttcgccggaaccattatcagttctataaaggaaaagggcattacgaaactccggacgaactgatagaccatgtatcaggaaagaagctcacccttgtttccgacggacatttctttcaatatcctcccggcagggaatccgcaactttcatcggacacatcaaggagacatcagaggaatttcttttccggatctatgaccgtgaatatttcctgtatcttcttaaaagactgaggaccgtgaaaaaggaatcggcacaggaacaaataaatatcaaatcataacattcgggggaatgcggtaaaatgactgccgtattccctcataaaaacaatacaagtatgaacaaatcaaacactctatactggaaaacagccacagatccggctgaacgcattgaggtcagactcgtcctgaacagttatatcgacaatgacaatctgtatgtaggacttgaatcccggtctaaggagaatccggaatgctgggaatcctacacggacatcaccgtcaacctcaattctcttcccccgttccatgcctatgtggacaaccgggactgcaacagacatgtgcatgattttctgaccagtaacagaatagcagaacctgccggatttgaatatcagggattcagaatgttccgcttcaatcctgacaggttgaaggaactcgcacccgaacagttcaagacaatcagcgccaaactgccaccacaggatgacatgataaaggacatcatctatcaggaaagacgtttccctttgagaactgttcaagacattcacggaatatatcttgtttcaagcaaggaactggaagaatctctgatcgaaggagtacggaacctggatgctgcggcatatgaactgctggatggcatctgcctgttctgctccacacaggaactgcgctatcttacggatgcagaactgatagaaacaatctacgcacaataaaaaggaggaacaaatatgaaaaccggagacattgtatttctgagacgtccctataagggataccgtgccgtcgaactgatggaaagactggaatgccgctggctggtcaggattgtcgagagcggtcttgaactggaggtatatgaagatgaacttatatcagaattttaatacagacaaagtgttatggaaaaatatcagtttgcattccattcggaaataatcggctatacctctcctcatatcggtgaggtcagaaaagccatacacagaaaagtggaaaaggaaaagtctgccgccataaagaatgatattgagctgcacatgtacaaagtgcatgacggcataccggttctccttaacacctgctacctgtacgatgaaaaaggatgtatggtacacggaagtatcaagggaaccaaggattatctgcttgagacatggagataccatacaaacagacattctaaaggcatcagttccacaagaatcaggccttgcacgacaagcagggctttttcatttgtataactcttaaaatcagaaatcatgaaccagacattacaacttacagactatattccacagaatgtaagcctctactacgtggactaccgggatgatcttgatgagcatgaagacatccaggaggaatgcatccgttccaacaaaatggaaaaactctatgaaaaggcatacgaatggtatgaggaacaggaaagttcaaacatgcacgactatctggaggagacaagaaagaatatggaaacggacaatttagccggagagtttgaagagcatgaagatgaaatcagggaacttatctacgaccggaacgattccgacccggtaaaggatatgatacgcaactcgtccgtcactaatttcttctattcgctcggagtggaaatcagcggatatctgaccggttgttcactgcggggagaatcagtcgccatggcctgccataaggtacgtcgcgcactgcatctgaaaaaggggcagtttgacgagaagattgaagaactggtagagaatgccacatacggtggagaactgcgcatctacttcaacgccatgtttgacaggctcatcagcaaaggccctgagaacgatttcaagagcatccgtttccacgggaatgtagtggtggtcattgccgacagccggaacggttccggacatcatgtacggattccgctggacatcactttccctttccgaagggagaacctgtttgtcgattcacaggtacactattcctatgccaatgaagtctgcggcatgaccaatgactggtgtgattccacaaaatgggaaacaggcatgataccttttaccggatctgtccgaaaaagccggatggctgaatacaagaaacaggaagccgcttatgagcagacattccgagacgggaaatgcaccttcggtgacatgaactacaaacgccaccgtgacgtgcggtattcgaatgaatatcctgccggatgcaggtgccctcattgcggtacattctggattgactgaaaaaacatttaccaaccaataaattcaaacgatatgaaaatctgctgttcacaagagcattacgacaaggtcgtacagtatgcaaaatcaatcaatgacaagacactggaaaactgtcttgaacgtctaaaacaatgggagaagaacgagaaccgtccatgcgaaatcgaactctattacgatcatgcgccgtattcgttcggattctgcgaacgttatccggacggaaatacaggcattgtcggaggactgctgtatcatggaaatccggacgaatcctttgccgtcaccatggaacgtttccacggatggagcatacatacctgacatatatgcgacagtctgtattggggagcctcatgcaatatggggttccctttttttatgccgcagacatgatgacagcatcctcatttcttgctgcaaaaatagctgtttgccgcgcaactcccgcaaggcggccctgccgggctggttgtctggaaaaaaatcatcctcgcttcgctccggtatttttttccgccaagccttgcagggatgcgggcaaacagacaacagggacaacaagaaataagaatgcctgtaccttacaggcagacaatgtataacaataaatatcagaagtcatgattacagaccagaagacacagaacaggcttcacgcggataccggaacggaactgttctccatcagacaaaggaaggaagccgtcacaaggatgctggacattctgaaagagactccggaatacctgcaggttatgaaccatataccggcttatgccatggatgacgatacgtcagaatggtggaaatcggaagaatcggaaaatttcatgaactcactcctggaagtgatggaaagctatactccggacggatacaggttcggaccgaaatccggcacgactgacctttacggctactgggaaagcaagaccgggcggacaaccctcttccatctgcttttcagtctggaaagcggatatgaatggggaaaaggtctttcccatgagaaaacggacgcattctacaaggaaataaaagagaaatttcatggagaaggattcgacacggacagaaccggctgtacatcacaggccatgtatcttgtaaaaggaaaaacacgcctgtacgtgcatccgatggaaataagcggctactgtgaaacactgcatattccacagattacagccatactgaaaaaaggaggccgtacattccgtcttgtaaaggatacgatagcggaagaggtgtattccttcaccgatgaagaagaactggaatattaccgtgccagatacggaacgtgcatccaccggaatatactggatgccttcagcaaccgccacgcagggaaagaggacatactttccatgatggcatcacggataaatgtggctacgacatcacatctttacggtatcggatatgattcgcctgcatacaggtttgtgcatgaggcatacgacagactggtaaacaatggaaagctgaaggagaatgtccgggaaatcggttgctgcaacatcataatggccatttcaaataccaacgcaatatgagactgaattacaatgacatgctgcttctggcaatatgggaatacaacaggagacaggacgaggatctgaccctggaactgtttcaggaaacattcggacaggttcccggcgcacatttccatgacaaatgggtgcattattacaacaagaacctgctgatgatggccgcctatttcaggggtgaggaagaaaacggccagaaattctgtgatatgatcacccgacaggttgaacgctatacacaaaacaggaggagaacaggatgaatacaaagatacgatatgaccttgacagtcttgaactggcaaacggtgacttcgggtatcccattacagaaaaggaagtacggaaagtgaaccgtatgctggaactgatggagaatgtccgaagcaggcagatgtgcccgacagaaggagactgcgtggaatttgtctcacgttctggtgactatttcggaaaagctcatatagaacggataacaggaaaatatgcggatatatgcctgataccggaaacggtattctgttttgatgacatgggaaaagccgcctatgataccaccggaagtccctggacgcaggtcaatatccggaacatgaaacccgcaggttctgaaatccgcatattcagaacatggggattcgggaagcgcagcaatacgggcagtctcaggttcgatgctccggtcaggaaatgggaatacagagaaccgaatccgttatatgacggttacaccacccgtaactggttccgctatcatatcatgaaacaccgggacagggaaaggacaggcgaatacaccttccgcagcgattcattcacgctgtacagccggagcgagctggacgagctggccgcaatcctgaaaggcagactctacaagggaatcctgcctgactctcttgtactttggggataccgcatggatattaaggaaatatcacgtgaacagtggaacggtatgggacagcacggacaaatccgcatgaaattcatgggatacggtccggtcagaatccacacggacaatgaaaaccataccgtaacagtatacagaatcaacgacatattgtcttcaactatcagaattttcatattttttcagttctttttttgtttcttctattaatattttaagccactccatgatttgtattgcatgttcatgaacagtttcattttggctatcactgtcgtgtagtagcctttgaaaatcacgtaaaatattgtctttcccaagcatctcccatacaggcatcatccggtggattatttttctcatggtctcacggtcggttatcctgtcagcagattccatctcctccagttctttttcagattccataacaacgagagaaagcatatgactataatcatccgtattctccagtaaactggaaaaatcgaattctccggaaactgaaacttgtgtacgagatataatggtggataaaaaagcaagcagtccgtggatattgaacggtttatgaatacagcctacaaatccttctttttcataaattccggaatttccgtcaccacgggcagtcatgactgctactggaacagttctagaattgccgatgtccgaattgcgaagcaatcttaacaaaccgaatccgtcagtatcaggcatttgtacatctgtcaagatcaaatcatattcagaattttcaagagcggccactacttcacgtgcattcttacaggttttacaggatatacctttgcgcccgagcatatcttccgctattttcagttgtataggatcatcgtccactacaagaacattcttaggcaatatagttattgtattatggtccgatttgtcttcctcaactaactcatccgtttcaggcaaagaaagttccagtctgaacatgcttcctttaccgagtacactttctacatccatttttccttccaaaaccttaattaatcctttggtaaggaaaagtcccaaaccaaacccttcagaattgacattctgtgcggcacgctcaaatggagcaaatattcttttcagtgtttcctcatccataccgataccagtatcccttatttcaatacgaagttttccttctgaatattctgaatggaaattgacgttacccctggaagtaaacttaatagcgtttgtaagtagattggctaaaacctgttcaagtttgtccgcatcaccttttactattacatttgatcctttatgttcagaatataaaatcagaccttttgaagtcgctttacgagaaaactcatctgaaattcgttgcaagaaacggtcaagataaaatggtgtgtcgttacgcaaattaccggcttcattgattcggtaagcatccatcaaatcattaaccagatgtaaaacgtgtcgacaagaatgacggatgtcatctaaatatttttcgcgcttcctcttttcacgcgtttcagataccaaatctgcacagttatggatattaccaagtggacctctaatatcatgagaaactgtcaggatgattttcttacgcatatcaagcaaattctcgttttcttgaatagcttgttgtaatttaaatttaattatttcttccttacgtaaatctgattgtataattaaaaatgaaattaatattataaaaaccgcaatactcatcattacgataaataatcgaaaggattcttgtttgacttccgttacctctaagtttcgttctataaatgacagctgtacctgattatctaaaaaagatacaaaatcatataatttttgatttaacagcctattctgcaaacgcaagctatccacataagtttctatctgattgtttcgcatatctatgacagaaaccaatctattattaaaattctgtatttcattagttatataggggacttgtatcgtctccttctttccgaataatccggcaattcctttctttttctgagttattgtcttcacttttactgtttgagtagctattacaggcaattcattagtaagaatactatcagatttattcgcaaattggactgctttcattatttgaaacaagtgcatttctttcgttttaagcaattcccgtaaagaatcaatttgaactggacataaaaaatcacaactccttaattttatttcaagtagaacactatctgttttaaaacgttgattatgaaatatgttataatcagactcatcccatactataactgattcgcctaaagttgccaacttagtaatatacaaatgaactttattagtattctcataagcttcattaatttgaattatcagattctcaagttctttcaaccggcaacgttcatttatcattacagtaaccatacttaagactataaatcctgtaataaaatatccaataaatagtcttttgcgtaataatgaagtcatcaggaacattctattgatttatttgacatcataattctatatatttaactagtcatagtatatatcattctcaaatatttatttcaaattcaagcaataaaataaaaaaacacttcatattacaactgaactcttttatgaaaaagttgaatatatgaagtgtttttttattacgatataaactataaaatcctattcttcgggaactggtgtataaacccttatccagtccaccaggaaggtgtggtcttccacatttttcagttcctcatccgtagggcttaaacctttaacggctctccagctttggtcttccatatttattatgatgtccatgtcttttaccagacctgtaccaccagtgtagttgttggggtcgataatatccttgccgcttacggttctgacaagttctccatctacataatattcaagtgtgaaagggtctttccagaacactcctacacgatgaaaatcgtcgcgccacaatgttcccttgtcatccttataccatgagccaagatctttcggctgataatccttgaatggctggcggatgaatatgtgatggctcaggtgaagtctgtcggcaccgtaacctccgccgtctctgtcgccgccgtatgcttctatgatgtcgatttcctgagtatcgtcagggctgagcatccatacatcggatgccatggttgaatttgaaagttttgcgtatgcctctacataaaccggatactttacacgtgtcttcgatgtgatacatcccgtataggttcccggcagttcctttgtgttgggtccgcttacaactttcttcatggggacatcttcaggacggctggctcttattttaaggtatccgtcggaaacggaaacatggtctctctgccatattgtaggagcaggtcctgtccaatgattatgatagaaatcggtccatttggcatagaactcttttcctttatccttttcgtcggcaacataattaaagtcgtccgactgtggatggagtttccacaccataccgtcgccggcatcagcgggtacaggatagatatcccactcgtacgatttattattgaaatcttctgctgcacaggctatttgcagcgatgctaaacaaatggtaaacagttttctcatcgtggtatcttagtttaagttataataattattttcgttcttttgattcacctttagcggtatgtgtctgcaatgtccaggtagaaaatctcattatgctctgatagtctgaactgttgtatatatgagtaagaccccatctcaatatttcggtaggttctttttcggcatctgcactgcggttcaggccaatggcgtgtggcgcgccttttactactgacattatttcaaagtttattccgtcaggcgaccactggagtgtgttcttttcaggaccgtcggtggtgataagtgaagctatacctcctttgtaaggccatacgcaaacttcatgcccgctgtttgaaataggattatattccgatttcacatacggacccataggattttccgcaatagccactccgtgtttgatttcacggccgccccatgttatttcttctcccatacgttcgcctttgtagtacatatagaacttacctttataaggtattatacacgggtcgtgtaccttatgactgtcgaaatcacctttcgacactaccttgaatctgttatcctcatcgccttcccattcgccggtattagaaggttccagtacaggcttgtctgtcttgatccacggtccttcaggggaatcagcacatgccataccgatagtattctttacacggactgtgtaaggggattttaccgcctgatagcaaagataatactttcctttccattccatcacctcaggagtgaagactgaacggtcgtcgtaagcacctttttcaccacgtttcactgcaattccctgttccttccatgtccatccgtcttttgatgtggcataccatatatcacatctgtcccatgggaaaaccttatctttctctatatctccagcaaatccttgggtaggtccatagctctttgaataccatacataatatgtattacctattttcagcattgcactcgggtctcttcttactacgccctcttcataagcaagatcacctttaagtggttccatcttatactcaaagaaccatttattgtcgtgattttcccatttcatggcacgtttcatagctgcacttaacttatttcccttaggtattcccaatgaatcggccttacgctcatcataattctgagtgtcgtcaacggcaatagtctgtgtattgcctgtatttccgcatgctgccaatagcgacatcatgccggctgcaagaataatttttctcatactagactttattttatattaattgttagtttattcgagtgtaattcacttgtttctgcactgatattcagtaccgatgatttttctgtcgactgaagcatcagcatacatcttccctgatatgtcataatatccttactttgatatggagaaacgttcttcacgtttccattgtctataccaagcagacggtactctccatcaatgttgaacttaagcatctgttctgttgtctttacaggattaccttttttgtctgttagctgagctgtgacatgcagaacatcctttccatttgctgcgatactttgtttgtcaaccgtcagcaatatcgaatgttctttgcctgaagtccttatagctgtagtggtattacctaacttattttttccttttgcggtaatagtgccaggcttgtactgaactgcccatttatagatatgatcctcaaaatcgtctatatacttctttcccatcgacttaccgttaacgaaaagttccacttcatcacaattggaatatatctctactattaccgagtcacctttctgataattccagtgagagtttacatcatcccaaacccataattttctatcccattcatgtcctttcttatcagtaaatccatcttttacatggagatacgaagatttgtctgtagtctgtgaatatatagcaataaaaggcttgtctgtccacaatgatttcatcatgtcgtacgaaggcttcacatagccgcacatatccaggagaccacatcctatcgacttttgaggccattttgaaagacggctttcactttctcccagataatcgactcctgtccatataaacatacccggaacgaaatccctttcaatcaccgccttccattcgtgccactgaccgagattttctgtacccattataggcttgtcaggataattcttcttagcataatcatacatcacgcgacggtagctgaagcctgccacatcgagcgcgtcgatatatcctgactcaaagcttatggaaggcaggatgcagttggcggtaactacacgtgtggtgtccatctggcgtgtccatgcagctaatttttgcgctgtacggccaatgtcgtatgcatgtttaggctggattttccacatttctctgattttttctttagagtatggaggctgattccagaaataattaccgttggaatcggcaccgaagaaacctgtcgcctcgcggcatccggtataagtccattctatttcattacctatactccactggaagatacaggcatgattacggcttctcctcattacgtttttcaaatctctttctgcccattcctggaaatgctcgcaatagccatgcgtaggatagtcttctacagtttccttcatattgagtcttttatctttgggataatcccactcatcgaagaattcttcctgaaccagaagacctatctcatcgcacaaagacagaaactcttccgctcccggattgtgcgagaggcggatggcattgcatcctccttcctttagggttttcagacgccggtaccacacatcgcgtatcattgccgcgccaaccattccggcatcatggtgcaggcatactccttttatcttcatgtttttcccgttaaggaagaaacctttgtctgcatcaaaacggaatgtccgtatgccgaacctgacagtgttttcagaaattacttcatcgccattcttgatgcgtgtctcggctgtatagaggacaggtgtatcgacgctccacaaatcaggctgtttaatctcagatacgatgtcgataattttctcctcaccagcattcagttttatactgaagacctcaaaggctgcgatattgcctttattatccttatatactacctcaacaactgcagctctgggttcggagtagctgttgcacacggtaacctggttgtttactttagcatatttatcagtaaccacgggagtagtgacaaatgttccccaaaccggaatatgcagtctgtcggttacaatcattttcacatccctgtatatacctgaaccggtgtaccatctgctgtcggcataatggctgtggtcgacccttacagtcatacggttatcctcattgggattgagatagtctgtgacatcaaaataaaaaggagcatatcccgaaggatgatatccaagctttttgccatttatccaatactcagaattattatatactccatcgaacactatatagcatttctgatttgcactgattgttgtgggaaatgatttgctataccatcctattcctccctgaaggaaagctacacatccttcacccgaaatggaatcgtaaggtaaaccaacactccagtcatgtggcaggttcactttcttccattcatcaccagggacataagaagtatatgaataatgagcagaatctttcagtacgaatttccaatctttattgaaatcaacatttgaatcagatgctgaaacctttagggttgataataggattattaaagctaaaagatttttatttctcataatcttaggttttacatgttttttgatgtcacaaaactatatctttcacttataatatatgagggggatattaatgtgatatagggtgggaaatcagaattttacatctgccctgtattccaccgtcacctacaaccttgacaaaggatgttcctttcttccctcttatggttctcaggacaaacagacactttccgttatatgtccttacactattgtttatgacgttgatgttcaaatcttctatcgaaggcgatccattgtcgagtccggcaagttcaagcttgtcgtcgaggattatcctcacatccgaaggtatatcgactactgtgtttccttctttatcttcaatggatacttctacatggataaggtcataaccgttgtcggtagctgttttgcggtcgcagttcagtgccagacggcacggcttgccgcttgtggacaaagtgtctttcgacaatattctgtcgccgtccttgcctaccgcaaggagtgttccttccttgtatgccaccttccacatcagtatattatgctccatgaaatcgctgcgtttctttgttcccaacgatttgccgttcagaaacagttccacttctggggcgttggtatatacctgcaccagtatgtcctcgtccctgcggtacttccatttatcgcgtgtgtcgtaccactcccagcgtctgatccatcccgggcgtggagtgtaggtgaaacttccgtcagtatccatcttgaactcgctttccttttcaggtattgttacaatatgggttttcggtgtgtctttccacagacattcaaagaaatggccacgcgctgtcttgttgcccacgaaatcgaagaaagaacagtctccaccccttgcaggccatgggccgttctcgccaagatagtcgaatcctgtccacacgaagatgcccgctatgtacttcttgtcggccacggctgtccattcaaagagctgaccaacattctccgaaccgataataggctgatatggatatagcttatggtcgatttcataatatttgtctttatagttatatcccactacatcaagaacgtctgtatatccggagagacgcgaaactgacggaacaacgactcctgaagagacgggacgggtagtgtccacatccttaacccaaccggcaaggacagcggctgtttcagccaaatcgtcttttcctcctgacagacggttgaactctttcagtatagacttgttgtctgtttccgggtcgcccgtatggataagacccttgaaccctttattgtctttgctcgatgcccagtaatatggataggtccattctatttcattgcctatactccagagtatcacgcaaggatgatttctgtctcgcctgatgaacgacttgaggtcgtgctcggcatgcgtatcgaagtatctggtatatcctattgatatgctgtcgggcgcatcttccttagctcgctcagtaatccactttttctttgccaccttccattcgtcgataaattcattcattacaagaagtcccagactgtcgcacatttccagcagactttccgaatgcggattatgggctgtacgtatggcattgcagcctatggaacgaagtttcagaaggcgtcgcaacagggcatcatcgtatgcggcaacacccatacatcccaagtcgtggtgtatgttcactccttttatttttactgattttccgtttagaaggaagccttcatccgcatcgaatttaatgtcgcggataccaaattttgttgttttcttatccatcacatatccgtcagaagcaatcagagtagtatgaagctcatacatcgaaggcgtttcaagactccagagatgacaattctccagttcaacagatgcagtgaactcattgaaatcgcctttcagggcaacaaaatcatcggaaacagaagctattgtcttgccgtcgtacactacttcgtgcttcacggtgactccttttacacctgttccagcattcttcacctcgcataccacattcaccatcgaacggttgcctacctgtggtgtggtaacgaatattccgtctgaaggaatatagagctcgtttcttagaataagactcacattcctgtatataccggcaccgacataccatctgctatcggcatacgctcttctgtcaacgcagacagttattgtattcatcgaaccttttggtttcagatattgagtaagttcatattcaaatcccacatatccgttaggacggaatcccaacatatgcccgtttatccaaacctttgagttattatatacaccttcgaaatgaatgaacacttttttcccattcatatcatccgaggtgagaaaattcttcatgtaaatccccacaccgccagacagaaaaccattgcttccggctgtctgagtcttggtatatccttcgctgatactccagtcatgaggcagacacacatcctcccactttatatctggactcaggaacaaagtgtcctgaggcacgaaacctgctggtttgctgaatttccaatcgaagttgaaatccactttagtggaggttccggcataacagaatccggacagaaagatagttaagactgtgataatgttttttatggtcatatcgattttcagattaatattaatgacaaaaataatttcaaaagtgtaaaaacaaaaaaactctccatttatatttcagatatcaacggagagtttcatcattaaaaaaaataaaacattttataaagttactccttgcttaaggatagctatttcccggtatcccttcttttcgttcagtgcctgctttccgcttgccacttccaccacaaagtctataaaacgtctgcttaaagattccatgctttctccctctaccagagttccggcattgaaatcaatccacgtatgtttctgttcataaagcggagtgttggtcgaaaccttcacggttggaacgaatgttccgaacggtgttccgcggcctgttgtgaacagcacgatatggcatccggcagaagcaagagccgtacttgccactaggtcgttgcctggtgcgctcaacaggttaagtccgtgtgttgtgacacggtcgccatatttcagaacatcctccaccatcgagcttcccgacttctgtgtacatcccaatgatttctcctcaagcgtggaaatacctcccgccttgtttcccggtgaaggattttcatatattggctggtcgttgcggatgaagtagttcttgaagtcgtttatcatggccactgtgtcgtcgaatatctccttcgtgcggcaacggttcatgagcagtgtctcggctccgaacatttcaggtacctccgtgaggactgttgtcccaccctgggcaacaagatagtcagagaacaccccaagcatcggattggccgtgataccggacagtccatcagacccgccgcacttgagtcctatacgcagttttgacagggggacatcagtccgcttgtcttccctggctatggcatacatctcacggagaagtttcataccctcttctatctcatcatctactttctgagaaacaaggaaacggatcctttgggtatcatagtcacctataaactcacgaaaggcatcaggctggttgttctcacagccaagacctacgacaaggacagctccggcattgggatgaaggaccatgtcacgcaatatcttacgggtgttctcatggtcgtcacccaactgcgagcatccgtagttatgagggaaagatataatggagtcaaccccctcgcaacctgtttccttgcgaagctgctcggccaactggtttactattccgttcacgcaacccaccgtagggataatccatatctcattacgtatgccggcttctccgttagcacgcaaataccctttgaatgtatggttctcgttcgtgaatgtctgtttctcgaacttcggagtgtaagtgtatgtactcagaccggaaaggttcgtcttgacggttttctcgttcagcagatgtcctttcctgacttcctttacagcgtgcgatatggggaaaccgtattttatcaccatatcaccttctgcaaaatccttcagggcaatcttatgaccggcaggtatatcctccattaattctatggaattgccgttcacctctattacagtccctttggacaatgggtgcagtgccacagccacattgtccgcagggtttatctggatatattcagtcataacaaactaacatttataaattgaagaatacaggtagaagtatcaacctacaaggtcttttactgtctgaagcattccttcgctctggattttgttgatatagtaaattacacggtctgccagtcccgagatagtattaaggtcttcaccccaaatggaagtatcggcgagaactgtcttcacaagattttctaccgagccatcgttccacaaacttgtaagcatcgccatgatttcctgtgcatcgttaggaactatctctacaccatcggcacgctttccacctttgtagtatactatgatggctgcaagaccgagtacaagtccttcaggaagcacacccttacgtttcagatattccttcactcctggaaggtcgcgtgtggcatacttagggaatgagttaagcatgattgatgttacctgatggtctacgaaaggattattgaaacgttccaggacatcatcggcaaacttcttgagttcctctttcggcaggttgagggtctccatcagctcgtcgaacatcacacgtttgatgaacttgcctatcacctcatgttggcatgcgtctctcacgatattgacgcccgaaaggaatgccaccggcgacaatacagtgtgaggaccgttcagcagagtaaccttgcgttcatgataaggctcctccgacgggacgaacagaacgttcagtcccgccttgtttgcaggaaattcttcggcaaccgattccggtgcttcgataacccacagatgaaaagcctcgccctgtacaactaaattgtcatcaaagtatagtttagtttttatgttgtctatgtctttacgagggaaacccggtacgatacggtccaccagtgtggcatatacaccacatgcagtttcaaaccatgacttgaactcttcgccaaggttccacaattcaatatactgatagattgtttccttcagtttgtgaccgttgaggaagataagctcgcatgggaagatgatgagtcctttcgacttgtcaccgttgaaatgtttgaatctgtgataaagcaactgtgtcagcttgcccggataagagcttgcaggagcatcctcaagcttgcacgacggatcgaagttgataccggcctcagtagtgttcgagattacgaatctcatatcaggctgttccgccagtgccatgaagtcattatactggctgtatggattcagcgcgcggctgatgacatcaatcattctgaatgagttcaccacctcgccattgttcagtccctgaagattgacatgatacagacagtcctgggcattgagggcatcaaccatacctttttctataggctgcaccacaacaacactgctgttgaaatctgtcttttcattcatattcgagataatccagtcgacaaacgcacgaaggaaattaccttcgccaaactgtatgatacgttccggacgtactgcctttactgcagtcttactatttaaagctttcattgtaatgccaaaaaattaaaattgataagattaaaattcaaccaacattctgaataccttacctggattttccgaccatttctgcagagcctcgcctgcctcttcaggtttcactacggcagagataagttcgttcatcgggcagttgccattctgaagataatgtatcacggcacggaaatcctcaggcattgcattgcgcgaaccgcgtatgtcgagttccttctggacaaaatattttgtctggaaagccacttcactcttggcatagccgatacatgccacacggcctgtgaaacctacaatgtcgatggcagtaacatatgtgataggactacccacagcctctatcaccacatcagccatatagccgtcagtaagttcccttactctttccaccacattttcagtcttcgaattgataaccatcgaagcacccaggcgttttgccagttcaagcttctcatcgtcaatatccaatgctattacccttgcgccacgaagcgatgctcttactatggcgccaagtccaatcattccgcaaccaatcacggccacagtatcaatgtcagttacctgagctctcgacacggcatggaaacctacgctcataggctcaatcagcgcacattccttatccgaaagaccggcagccggaataacctttgtccaagggaggacaaggaactcctgcatagaaccgttacgctgaacacccaaagtctcgttgtgttcgcaggcattcacacgtccgttgcggcatgaagcacactttccgcagttggtatatggatttactgtcacgttcattcccttctcgaaaccgacaggaacgccttcgcctatttcctctatcacagcacccacttcatgtcccgggatgacaggcatcttcaccataggatttcttcccaggtaagtattaaggtcggaaccacagaatccgacatatttgatacgaagtaaaatttctccggctccaagtgttggtttaactatatcagctacttgaacctttccggcttcagtaatttgtacagctttcataatctatgtatttatttaaatttgttattgtattattttgatgttgcattaattcaatgttgttttttctctatcttatatcctctccagccataatatgccgtaaagaagaaacatatcagaggtattacatatgccacctgatagaagtccgcgttatgattcatcacaaatgcggtgaactgagggatgcacgcattacctataatagccatcacaaggaatgccgaaccactctttgtgtcctcgccaaggtcgcgtagtgcaagtgagaactgggttggatacattatcgacatgaagaacgacactgcaagcatggcataaagtcctgtcataccaccgaacatgataattactccacacagtatgatatttactatagcgtatgtaagcagcatatcctgaggtctgaatttcgacattagcatagtacctatccatctgccgccaaggaaagccagcatatacagtccgaagaatgtggtcgcctcatcctccgacagacctgcatacatgcagcagtaaactaggaacaggctgttgatggctgtctgccctccgttatagaagaactgtgcgataactccccatctcaggtgtttgcgtttcaacactgcaaaattgataagcttgcccttctcgccgtgcgattcctccttgtcaatatcaggcaacttatacagtgcaaacaccacagcaagaataatcagcaggactgcaagaaccagataaggcatcttcatggagtctgtctccatctgaataaatccgtcccaacctccgggaaagtcggcaggcagagtctcgcgagtatagttctgtccggtaagtataagcttactcagaaacattgcggatatgaaagcaccaagaccgttgaacgactgtgcaagattcagtcttcttgaagccgtatcgtgtgtacccagagctgtcacatacggattggcagcagtttcgaggaagcacattcccgttgccatgatgaagaagattacaagatatgcccagtattcctttatctcggctgcagggaagaaaagcagaccaccgatggctgcaagaatgagaccgacaattatacccgacttatagctgaaacgtttcatgaacattgctatcggtatgggaaacaggaagtaggccagccaataggcagcttcagtgaacgaggcctcaaaagcattcagttcacaggttttcatcaactgcctgatcattgtaggcaatagattactgctgatagcccacatgaagaacaagctgaatatcagtaaaagcggtataaaatatttgtttttcattctgacatgtttttaatataaggtaactcaggcagattcttgaaaccgtaaaaggctttcgcgttctcgcccaagaaaagttttttgcttctctcttccaattcttttgatttaatcacaaagtcgtacgacatcttgtaggtaatggctgtgattgtgcgtggatagtcggaaccccacatcagtttctcgaagccaacaaggtcggcagcttcgttgatggctctgacagcgctgcggaacggatagaactcgtcattgaacagccaagtgataccgcccgactcaatcatcacattcttatgacgggcaagcattatctgcttcttccaatccggtttagtcaccataccgaaatgcccgatggcaatcttcaagtacggacattctgaaatgatttcttccatctcgcccacctggaggtctccctctgccatatctatggaaagaatcacccccttgtcttccattagatgaaacatcctcatcatctcgtccgagttgagcatcaccctaccgtccttcagttgcaggcggtgtcccggaatctttatggccttgaaccctttgtctataagttcaaccgcctggttatagaaacccggttttctgaattcacacataccacacacgaagaacctgtccggatatttcgtcatcacctccatcagatagtcattctgaatgccgtcgatatactcctgtgtgacaacagccgcgccaatcagggcataattcatattagccaggaaaacctcagccgtgtttcttccgtcaatcataaagggggggggagcatttgtctcacctcccccataaacaatgattgaccgttctctgtagtcttgattttcaggccatctacttcagtgtcctgataaagccacagatgcgaatgggcgtcaattattgtataatccatagaaacagtatttatgaatttgcccaacttactctttgctgatcgcctattatctccttaaccttttccacaaggctccagtctatcggttcctcaatgtattttatgttctgaagcacagactctgttcttgccgagctgaacaatgttgtaggtattctcggattgcttacagagaactgcaccgcaagtttctcgatagggtatccctgttcagcacaatacttggcagcctttgcacacacctcaatcaatggttttggagccggatgccattcaggaacacctctatgtgtgagaagtcccataccgaacggcgaagcgtttatcactcccacaccattttcgtcaaaatagtcgaggaagtccaccagcttgtcgtcgttcaatgaatagtgacagaagttaagcaccgcctctactgtacccggagcggcatggtcgataatccatttcaggttttcgagctgcaggtcggtgatacccacgtggcccaccacgcctttcttcttcagttccaccagagcaggcaatgtctcgttcaccacctggttcatatccgagaactcaacgtcgtgaacgttgataaggtcgatatagtcgatgttcagacgttccatactttcgtaaacactctcctgagcgcgtttgtccgagtagtcccacgtattcacaccgtccttgccatagcgtcccacctttgtagaaaggatgaacgattctcttggcaattccttcagagccttacccaatacggtttcggctttataatgtccgtaatatggagaaacatcaataaagttcagtccgcgttccactgctgtaaaaacagactgtatagcgtcactttctttgatagaatgaaaaactccgcccaatgaagatgcgccataactcaatacaggaaccttaagtcctgtctttcccaattcacgatattccatttttgataaataatttaaaggttaatattttttactctgtttattcttattcatacagatagaacatacgttccatcatcttccatttctcgtccgatgtggccccctcggcacactgctggaatttggctacgtattcttcccattcggcctgacgcggcagagtggcaagctttgccatagctgtatcccagtcaaaatccagaggtgtttccactatcataaagagttttgaccccaatatgtatatttccatttccaggattcccacctcgcgtattccggcgcgtatctcaggccatgcctcttccttactgtgagcctttctgtaggcttcaatcaattccggattctcacgcagactcaatgtctgacagtatctcttcacaggcagggaataacttttcactttatatccttctgtcttcatgatattattgatattaatatgttagtattacatgtcactgtctttatcttttcgacgatgctaaagtatgaagtatccatcaaaacaatagaggagattttcaaaaaagaaagaggggatattataccccctctttttcgacatttttacccctcataaaggagataaaaagtcaccccaaactctataaaaaatcaaaacagattgaactgcattcctgtgtagaaaaatccctggttggatttcggattccaatacgtcatcaccgtcaacgggatttcatattccataatccgaagtttataaatcacattcagggacacctgagtaattcctgccgattcggcatacatggttctgttcaccatttccccgctttcatttcttgaatttctcaatgcgaaagctgttccaataccaggaccgacccttagcttttcgttctgatagatggtatagcccacatatacgaaactggagtagatgttcttgctgttgtccagatccctgtcgcgaccgtaaacaagtgtagagaagctcaactccagcggaaatttcctgtcgcccgtataattgaccatgagatcaacgaaacgtccagtttcatcaggcttatagttgaagaactccttattattatatgtagccccgggcgagaaattatatgtatctatagcctttatctgaaacctgccatgagtatatgctatatactggctcagctccttataactccccctggtgttcgatccgccaaggaaaccggcggtaaacctccccgatgggtcggaaaccgacaaatcggacgagagaatcagtccgtcggccacttcaatgccacgccatagaatcatgttctgtagagtagtactgaaatgaagctgagcctgaacatttgctgacaaaaatataaatacaggaattaacagtcgctttttatacttacaggtatccaatgataatatatgtatcatactcagagcagtagaaaatcggttttaaattattattatggatttatttgtcgaaatactctataagattataaacattccagttaatatccgacatgtatttggtcaatgatgtataaggtttatagttataatcgagcatacctttattgcaatcctcatcatccagatacttgaagaaaacccatcctacacaattcttggcttcgagcagtcccaaggtaaaatgctggtaagcgaatccacggttttgctggtcgcgtaccacgaaaccagctccacttgaattgtcaagcttagtatcctcacccttggtatagaattccgttaccatgaaaggagtaccgcccgcctggttcttccagccatccatgtagcctttttcaggcgaccatttactataataatttatggaaatgacatcacaatattttcccgctgccttaattatataactgttgtatttaggaaggctgtgcaggcgtgaacccagataaagcaattcaggatccttcgatgccttaaccgcattctttatggcagaataatatttttccgcacaaataccggcaaactcattgttcagttcatccgttacatcagaaacatttgcactcttgtccttatccgtcataaacttggcggctgcaatataagcaggatcctgcttgtttgaaattttcaggaatctgtcgagcagcctgtttccccatgtagagaagtctatctcattatccgagaagaatcccaacacatccgggttgtttctgaacatgccgaaagcatccgaattgagatactccttgcaccattcatcccatccatcataaaacacaagacctatcttaagattcacgttctgccccggatagctaattcccttgctattcttgaactctgcaaggaatgaaaaggaaggagcctgtgtcagaggacttgaagccgatttattataatcatttacagccttgtcgccttcttccttaccgaaagcgcagacactatgaaatcctatttcagagaattgtttctgcgactttgccacccagtcatctactgaactgtaaagcttgccgaaagctgagctgttgccatccattctgaatgaggcgataccccttacataatatggataaccttcggggtcgactatccaacttcttccatttgagtttttctcaaccctgaaccgtccagtagccttggatttttgcccttttgcgtatgagccatatttattcacgctttgcaaatactcatcctgtgtttttgtctgctgttcataaccaaccaggtatggcaatatccttgtctttgcctctataaaagccttgtcaggtttttccgcatactcgacaattatcggttgatactgcttggtgctattaggataggtttcagcaggaccgggaacaggcagttgcagttctacatcatcatcgtcattatcgcctgcattgtcgccgggagtattatagtcctccacattccccggttgtgagtaaataacctcaggcggaatatatgagaactcctcctgagggtcttcacatgacaaagcgaagaacggaacactcaagcaaatggttttagtaataatagtagaatatttcattgttgcaaatatttagtaaattaatataaatcccatgtcctgattgtatccccccatcggtggtctatcgggaactccatttctccccatgccttaacagaagtccaaggttggtcggcatcagtccagaatgggtcagaggcaggcaatcccaacggaaggaatgcaagtgtagtcatatacaggctgccattgtttgtataatgattcgaaatgccagtctgatgtccgcagaatcctatggtgaggaatccgccctcattgaagttattgcccgacttgaacatacgtttcatacacgctgtcagcgcacatctcacctgtgctttcgatactcccgccggcaactcattataccatgctataagagccagtggctgcattgttgccatacggtaaggtatagagcgtccgaaaacagggaatgttccttcaggagatatgaaacgctccagaatcatggcgaacctctgtgccctcatcaatgccctgtcatagtacttgcgatagtcgaaacgtgtcctcacgcccgattccattattgcatgtatagattcgagatacataggatggaacacataactgctataataatcgaatgcaaagtgctgtccgtctgcgtaccatccgtcgcctacataccattcctccaccttgcggaaagtagaatttatacgatatgtatcctgtccggcatcaattttggcaaggaagctttcaatggtggccgagaacagcagccagttagtgtaaggagggtcaatgcgtcggagacctttgaactcttttatgtagcgttcctttgttgtctggtccagcggtttccacagctggtcgaacgcgcgcaggaaactttccgcaatataggcagcatcaaccagtgcctgaccatgaccgttccacaacagataatccggactattagggtccaccgcatttgcataactcttcaatgcccattctttcagttgcttgcgctgctgtccttctgctgtatcatcgtcaggcaggctcaaccatggagctataccggccatgagacgtccgaaagtttccatatatgcaaccttcttgttacggttatcccagtttggacttacctcaagaatcatatttttctgcagttcccctttcgccatattgctcaacacaggagcagccatcctgtaagccatatccgtccagtattttcttgtctcgttgttgtttgcctcgagataacgcacatactcgcaagcggcaagaaggaatgcgcctaccccaaagttggcagtcgacttggcgtcaaccacctgtcccggaatagccttttcaccgattggctggacataacccaccgaccagtctttctgcagtgcagtcttggtaagatatttccatgctttccccactacaggcataaattcatccttgtcaagataaccgttgtttatcccccaaagcataccgtaagtgaagaaagcggtaccgcttgtttccggtcccggagcatgttccggatccatcatacttcttgtccagtagccctccggctgctgcagacatgcaaccgcctttgccatacgcacaaacttatcctcgaaaaaagacagatgctcataaccctccggcaggtccttcagcacctttgccagagcggcaagcacccatccgtcgcctcttgcccagaaatccttctttccgttcagactcttatgcttgggataaacatattttgcgtcgcgataatagagtccttcctcctcatcatacattattgagtccgacgtacaaagatattcatacagtttcttaagataccggtgattatgcgtaatcttatacatcttcgtcattaccggcatcaccatataaagtccgtcgctccaccaccagtaatccttacgcggtgtgctcatctggtactccatgacttcgcgtgcacgcttgattttataattctccggcatgacgttatacaagtccgcataagtctggaagcacacctgataatcgccgaacagcacataatcatcctttaccccgtatttatacttccattcagatttgttgttgcttttcgcacccatccactggttatactcagcccatgcctccgaatactttctgtattcttctttcccagtaaggaaataggcttccatattaccggtgtgatatgccgcataatcccagaaagaccttgcttcgggggcatgatttttctgccaggcatcgttcactttttcaatcatctccctaacttgctgagcctcagtttttttttgcgaaggaaaatgaaggtaaaacagctataaggatgtataacatccagtagtatctataacagttcatctttgtgatattgtttacattttctaaaacgaaatggggaagaatatatattcctccctcatttcacgaataattgtattattatatttatttgttaggagtccattctgctccgttgttgaaaccttctgttgtagagtcaaaacttgcatctgctcctgtacttggtctttctgtaatttcttcaatcttaaaagaagtgattttagcggttccagtagcatcagtaccaccagggacattagtctgtacagttaaaataacgttctcaagaaccggccacacaagtgaaccatctgctcttgaagctggagtttcagcagaagtagaactactgattgtgaatgtatttgtataggttccacttccggtatttcttccaatccagaatttatatttatcagatgctcccaatctgaatgttgttgcacagtcgttagatgcgtatgtataagtaaatttgtaagtacaaccatcacggaatgacattgatttagtaactgggaattgattatctgctggaacaatttccaattctccacttgcattaattttttcggcaactccttctgcaagatattccttaactgcatctatgttagcgaagttaaaatcaaaagcatctgcatgagtcaaagcaacattggcagattcaatcttgatattagcatcttcgttgttttcgtttttagcagtcaaagcactaacagcataatcagtgttataacttacgctaatatttgcgtcattactataaatcttatcaccaagaataagagtcatagtagttccattcacagaaccggaagcaacaggaattgtttttcctgctactgttatggtaaatgctttgttaacagcatcagtgaatgttccagaaacttccttatcgagtgtaagttcaattcggtcattacctgttgtctgatcaggaacaatttctttagctgaagaaacggcaacagtagtttgtttttccaaatccacaggaggttcaccgcctccttgatcatcattcaatactatcgttacaatctgtcctttagtaactataaggttttcaccactgaagttataagttttagtaccagaatttcttgtaagttctaaagtaaatccatcggtaaatgtcaccggagctacaaccattgagtattccttggcatttttattttgttcattaggaccaacaaatgttccctctttagcggttagagttataacattagaaccggattccactgtcaggtttgctgaagcatcaatttttacgttccctgcaatctttacatcaccaccagcagtaagtttaatacctgtaaggtcagtaagattatttttaaacttaaccaatccacaagtattctggaaagttaaagatttgttattatctgttgcagtagcataagatatatttgcatttgcatcgaatccccaagccggagctgtctgttcagatggcagtgtagtagttacgacaccttcaagacacacagcttcggcattataaggataaagagctgtatatgaattgttaggtgtagccttacctgtaaacgttgtaactgtgctaccacctgtagcggtagtaaacttgttattttcttggcctgaaaagatattgattgcatctcctgttgtccaccacaccgttgttccattctgcaacgaactacggcttgaaggcgtaccggcaacaaaagtcatatcctgaggaccactgactgcatttacattcgacagttcgtcttttgtacaagactggagcattgcaatactcatcaaagccgctccacaaaatagcatcgtatttttcatgacataaattatttgttaaacagtttcaataataaaaaatcacatcacttgttattcatattcttattctttaggatcaggtttccattcagtaccgtcatcttcaaaatcatcatgaccgccatctacaattccgggaggtattgatattcggcataccgcactttttattccattacccgtatctacagaagcaccgatattagaatctctgcccccgtcgattgccacgaccgtacatctcattttatcgtccgatggtgtaatcatcaacacatcagggaaagaagttccccaaactattgacttgtaaccggtataagggagattatccttggttatattaatacccaactccacagtgccactatatggtaattctatataactgacaggtttgttgtcagtctgcccatccttgaacactacatattcaatttttatctcctcagctggtgttccatcacctccacctacgccatcatcatccttatcacacgagattgccgtaaactgtataaaaagaagtatgaaaaggttgtatactgacagaatccgtggttttatatcaaccataataaaatgttatttaagcgccaaacaaaattttcaatattcaaaaggcataagaggaaaccctgaatatgccttattaccatgaaaacaaatcaatctacctttttcaatccggaatcagaaaaatatgttatttatttagaacatatttttccgatttgccagattacaatcacaataaataaatcaacaactaaatctaattacctaatcttataactaaaccctcaaacaatgttatttaaccttttctatcttgacatcatcaagcaggaagcatccaccattacctgaacccggaacagctgtgaaacgatatacaaaaccattttcctgcaatttgaatttaactgttgtaagattgtaattcttacggtctttcttgacctcagcagtggcaatttcttccagtttctttgaatccggattatagtactcaatcctgaagttaggtttgtcaccccaactgtatttggtataagctgaaatctgatattctgctccagtttcatagctgatgtttacagcctgccacataccaaccttcacctcaacagcatagttgcctgaatgtgcctttttcgcatcaactattttgttatctttcttttcccagacattccatgatgtcaagtcacctgactcaaaatcaccgttcttaatttcctgagcgtatgcagaagtcatcatcattccgcaagccatcattgctaaaatttcttttttcattttttctaaggtttttaatttaagtattatgttgtatctattaaaatcactcttctattggaaccaacttataagccctgacccagtcataataagtagtacttttgtccttatccttcaagtcctcagctgtaggtacttgtttttcccaatcgtatgtttcagtaactatatgtatgaacataggtcggtcaaacggagtatctgtatattttgttgtaggcttgatagtgtacatatactttccgtcataatagaatttcacggtatttgcatccacccaccaacaaccgtaagtatggaaatcttctgccgatgggtccgtcatatacgaaaccacatccgaacgtttcgccgtattgtcagtacgtttgcctccttgttcctgataccaatagtgagtattactgttcatctgcatattccatgtcttgttccacggattatcagggttgacacttcttattatacccattgtttctataatatcaagttcctgactgctccatgtctttatcttcttgccgcctttcattatttccttcattaccgggcggttggaaagccaaaaagtagacgacatggtagtgagcgaagccttcatccttgtttcataatacccataatgtgcctggttctttgcagaagcaaccgctccaccggcaagacgatatttatcgcccggctttccatcaagtccttctgttggcgacaaaacggtattgattatacgaagacaacctttcttgacactaacattctctgccttgaaagttgcaggcggccgaccgttagtccaataaggacttttagcatgccatttagcggcattaagacgtttaccattgaattcatcagtataatcttcgttaactacccatttataaccctcaggagcctcaggcaaattttttatatgctcttcagccaaagaatattccttatcattttttaatgtataagatgacaggaataaagatgcagcagataaatacaatactgtttttctcataaactttgtcgttttagattttttgttacacgacaaaagtatataagtttcatgaaagcattaagggggatttacatcgtaaaaggtggggtaaaattctaccactccctgaaacacaattatttcactcatgaaaccatgtgtttttacgatatataaaacccgacagaagaataataccgtattaccggctaatttacataagaataacttttcaaaccgccatataccccactttacgtccgtaccctcagtcctcgactccggcaatatgttttccatatcgagatctatggttttctgcctcggattcaaccactaactgtcgagcatgtggattgcgtatctgtcatagaatctctttccgaaccatattatctcgtctgtgctaagtatgttgttcagacggataatctttccggtattttaccacctacttctcttgcaaatcctgatctgatataaccggatactctcaattcattgatttccgacttgtatacagtctgcgaagaggcattgaaactactgcacagactgaacagcagcaggggaataatttaactgattttaatagtagacattctgtgttcataatatttcattttaatgattacgtttctgactttcgtctgatgcaaaattatgaggtatcggacggggttgtatctttcagtaaaaatcagtaaagtcttggcaaggggtaaaaaacttaacatcttgtatataaatatattacaaacaaggtgcaaagattttcagtaaacgatggcgaatacagaacctatatatttacacgccataaaatgaagaaaaagcagtaggaaaaaaatgcgggcaagttccggataaaatgtgggcaagtttaaggtaaaacttgcccgcattttagatagaatgcgatcgcatttaaaacaagtaaaaaacgaagaaaaaaaatatgtgttcttcacagaacacatatttcaaaaataggtataaacacgctaaacaatgttaacaaaatctatttataaaaaaagctcacatcaataatatctgcaacatttttacaatactccataaatgaagagaccttgggatgatttatacacagagctatctgtgatgtaggcgaaaaacgtcctgtcccgtcaagaaacgctgtaagctcagatgggaggagtatactgccaatacctggatttacgtcagtcagaacgactgtatttacagcttccaccgctgacacatcaagataatcgagtgccggaagatctgcgaagtgcaattttcctatcatattgccgcctttgctgccctgaagagagacactctccaatgaagaacaaccggatatatggatttcactgtcgaatattgaagtttcggaaacatcatcattaagtataacagaaggaacaactaccaattgaagcgaactgttattctccaccctaagtactttcaatgatgatgcggaacttaaatccattcccaaaggtgtatcaatattagagattgaaaatactgaaactcccgaagacggcttgacatacgacatggaataatgcttggacttcactcccgaaatgtctacttttcctctgaaaccgggatttgacaatatatactccacaccctcaaggttagctgtctgcgacaggaaaatgaggtcgttcccttcggttatcctcttcgtgacatcaatctccaacgatgagacaaacaccgacgggaagtttctgtaaagatatgaacggagcaaaggatccggtactcttcggtttactgtatattcagtgtaatttccatcctcgtccgacatcacgacaagacatttgtccgtcatggctttatagaatgcaggtatgacatctgtattccattttgcaaagtaaggaagtttcagatttgtaagacttttacaaagcaccgtagtgccatcggttgaaataagattgagatacgaagttatgccgtcattgccgcgtaaagctaccgattttattccttcgggcaggtcagcaaagtcgaatatagaaaaactgttacactcaagattgacatctgcgagcgaaggaaaactcctcaaaccgctaatagatgtaagttcgcatctactcaagtccaaagaagtggtattgagaacttgattgtcacaaatcagctctccgttttcgctgaaattaaatcctttccgggtcaagacatcgcgtaactttgtatcaaaagtcacttcagacacttcaaagtcggaaatttctgtttcatccttacacgagattattgtgaaacagagaactatcagtacataaaagctaataaaattcctcataacaatcagttttgtggtaataagactatattatcaatccaagccgcgtcgttctgtctttcgcacacaatggcacacactacttttttcactgtagaattaaaatcgaaagatacggctttataattgccgggagaagaaaattcctctgtatataccgttcctgtagacatatcctgtagcatgactttcaacttacatgctccttcggtctttacatcagcagagaagcgataagtcctgccactctccatgtcaaccctctgcatgagtcctgcatgaccagatatacaggctacattattgcctgcattgtcagtctgtacgcaaaccgtaccatagttacccaatggctgccatgctgaaagtccttcgctgaaggttccattctgcaaggtagagacagtatatttctcaacctgcagtatcatggacgatacgtgacctcctccgtcggaaaaggtgatgtcgacattattatcgccattcttcagcagctgtatgtcgaacggtacttctatcataccgaaaaatatattgcggttgctctggccgtagcctttccagttgtcgggaacactcacagcggtaccattaatctttaccaccggtttcttggaagcagagacaggacggcctatcgacatacgcaagcttgctctgcccgaaccggactcgattcctgtgaaggggaacgaaagggatgatccggcggaaatcggtttcagatactcactgctgtaatatttattgcggattatggagttcgtgaatgctgacgaagacacatctgctacaaggactatggtctgatttgggacaattgagatgctttcaggcatggacgggacattctgttccgtatattctatacctgcgttataattgacatatagagaacgctttgtgacattcgatacatccttccagctattcttattgttcagatatacagtctgcgggttatcatcaagattatcaagggcgatatagagtctgcctccatccttgaatgcctgtacctgaatatcaggattactgctggttatatcaacacgttcgccttttacattcttccagagttcgaagaaatattttttgtcattaagcctccatgtggtattcttcagattctgaggattgtcgggaataaacagtgccgcactatatgaagtataattgtttgcagcggtgatatgccactcagccttatctgagacaaaaggtattgagataaacaaattgtcctgacgttccatcagattaaacagaaaatgattaaacgacgaaacactccgcacactgcttatgtcatcatagctgtcgtcgggcttgctgttgtcaatacctccaaactcggaaatggcaagaggcttgacatgtccgaacttaatataggaatacgcctcaaccatatcaagaactgcttcggagttacttcctgaacgtttcgtatcggtgccggttacatttattccatcataaagatgtacagagaatccatccatatatgcacctgcccgatcgatgaacattttcatgcgggtgttccagtaattgaagttcccatcctcccaggcggggtaggctgcggcatagcctatcaccttcatctttccgttaagacgcggattattgtgtatatgtttacctattgaagcataaaaatcgaccatcagttcgcgcatagcctgtccctgaacggtaaaaccggcatcatttgcatgaacgaacggttcattgaggggttcaaaaaactcaggtaccagctcgctgttggaataatactcagccgaccatgcacctgcagcctgaacgtctatgccgccctgtatgtgctgtacatagggatgctctgtggcaatatatctttttacggaaatatttccgctgtatggtttcatctgaggatatttgcctacctcatgcgtcttgttatacgcatacgagtatggtccccagaactttcttccaagaccgacctgatagtcggcaagaaacttgcctacatccttatcatcatcggaggtggaatgaatattgaaatatttagaacggtcgagttctgaaacaccgctcaaaaagcgacgggtattatagtcgacaaccacctcgttcctttcctgacaataaataccgggaggaacacctagggtaaatgccgataacagaaaaatatatttatagctcataatttctttccttttagacacagaaacttgtcagtcctgatgtggatacattattttctcactttcttatcgtagcgttcagtctgaagaatcatagtagccacacggcctccattatccgggaatgttactgacaccgaattttttccttttctgattaaccggtagtcgaaaggtatttctatcataccgaagaaatcgtctctgccggtctggtcatatcctctccaattgtcgggcatgtcgactttcttgccattaaccattatttcaggtttcttcgacatctcgtgcttcctgcctattgacatacgcagaacagctcttcctgtacccggtttcagaccatcgaaatcaaacacaattggttttccggcttccaccggctgaagataagtgttgctataatatttagtacgaactattctgtttgaatactttttacggatgatgtcggcacacaatattattgtctcatcttttataatgtcaatactttgaggcatcgagttcagcgtcttttcatcataaactatacctttatcgaaaatcatcttcaaagagcgcacagaaacattatctacacccttccaattcagtacgtttttcaagtttaccttatgtgtatagtcatcaagattgtcgacagctatgtaaagcctgtcatcgtccttaaaagctgccacctgtatgtccggattgtcggaaacaatatctacacgttcgcctttcacatccttccataacttgaagaaatatttcttgtcgttcagtttccatgcggtattcttcaagtcgtgaggattgttggcaacaaataaagcagctccgtatggttcgaaattatattgtttcgttatatgccattcggccttgtcagaaacaaagggtattgagatgagcatcttgtcttcgcgttcaagaagattgaacagtatatgattgaacgaagcgacagttcgtacagaggctatcggattatatcctttggaagtgttgtctattcctccatattcggttacggcaagaggaagaactttccccaagcggatgaacgagtagttttccataaggtcgagaatagcttcggaattacttcccgaacggcgggaactcttgcctactatgtttattccatcgtaaagatgtaccgacaagccatccatgtactccccggcacggtcaatgaacatcttcatagtattattccaatggtcgaaatcgcgcaactccatagccggatatgccgcggcatatccaatgattttcatttttttcagacttggctcagcgtgaatatgctttcctgtctgtgcataaaaatctgccatgagcatcctcatttcctgaccatgcatattgaaacatttgtcgcgtgcatggacaaagggttcgttaatgggttcgaaaaattcaggaactgcccctttcacatgcttggaatagtattcggcagcccatgcacccgccttcactgggtctatgccccattgtatggtacgcgcgttggcatgttccgtagcgacatatcgttttgtttccttcaaatcagtgtagttcaaaggcttttctgaaaaaggatattcgccaaccttttttgtcttgccatatgaataagagaacggtccccagaaagagcggccgattcctacaccgtaatctgcaagaaatttcctgacatctggatcagaatctttagatgtgtgtatattgaaatatttacctctgtcaagtgccgatacatcattcaggtatctctgagtggcataatccactgtgacagtagtgttataagtcttattctcggaagatgataaaggaaaaaccgagaaagacaaacacacagacaaagctgtaagaattatgttattcattgtattatcaaaatttaaaaggcagagaacactccgatagttcaattaaagtattccctgccattaagattatcacttctgtttaaacactaatatcagaaatcggccggtttgagtacatcgttcagcaccacttcatattcaacttctgttccgtcgttttcagtaacagtaagatggccgtaaccgccacttgagttattttctttcttaccttcaaacatgaacattctcttcttcgtcacttcctgttcttctttatcgcctgtttcaggattgataacttcttccttttcagtatagacttcattgaaagagaatgagagatgtttttctgtatccgaattgattttcagccactcgggcaattccgaaggagcctcagacgactcggcaaagaactcgatcttattcattctcaaagtctgatagtcattcttccaggcaatgaggtcgaacaattcgcgataaacagaaaacttggaaacctcgcctgtctttcctgtttccacattcttgagataggtaagttcatacacgggagtagaatcaagttcgacctcagcccatttgtcattatcacatgctccgaacaaaaccaaagcacataagaatgtaattgtcttataaattttatctattagcttcattgttactataatttattatggtcttacttcaatatatccgaaaaatatatcgtcaaaataaatattatccttaaaggcattaaagcgcatactgagcaatatattgtccatttcagcctttgaagtcacagtggttgtggccgacatccatttgctgtcggagccattcacaatgccgcaccatggtctatcgctctgccatgtcatatcttcagctccttctttacctgccggaacgaaatacggactcatacccttaccctgtttataccccggtgtataatatttgtagctgaaagtatatgtacctttaccaccagtaaatgtcttggagagtaatgccctgcatcggtcaaatgcttcgacaaacatacattttgcactgttgtttattccatccttcagaggattgtccacaacctgtgaaggaactacaggatgtgttttggtatcggcatcaataactttccagtcggcatatgtgtcagaattttcaaaatcttcatccaggaacgcaccaaaagtagtcgctacgtttggagctgtagcctttatctcaaggttctgatatccaaccaacgcttcagttaaagttcctgtaagggtcagttcatctgtgttatagattttctcaaccaaagtaagaatcagttcatatctgctttgcttgtttacttctgctgctgtgatgtttacgctacccctgacagctgacggtctgttatacgagttggagtaagtaagctttagagatgatggatttatctctttatatccaaactcagaattatccaaatctatagcaatgtgtgtttggtcaatctgacggatgttataagtaataggatcatcactaggtactactgtaatagccaaaggcacaacaagagtttttggcgaagcttttggagtgtacttacctttaccctcactggcagaagttctttctattgtcatggaaagaagcaatggcttatcgctgaatttctttgcagtgaactggtatggagtgtcaaaactggttaattcgtcatttacgccagtatccgcacatttgaaagtccatttgttaggcaatccgtatgaatcgtccttaatatagacagacttaccatattcaagttcgtatttttcgtattcgggagcttcctcagttccaccgactattccggtctttatttcctgtgtacactccggatcactgtatacctttacggccggtacgaggttaggatcatacacgcggatatggaaagttgtatccatcacatatacatcaccctcctgcttagcataacaatattttttgatatatcctccggtattgtcgtcatacaccgaatatggatatacaacctgtctgcggaaagtattgcacaaacgtaccgtatggtcaccgggtttagtgaaatacacatgtatggttttcaaatcgttggtatgagggatggattcatcaatcaggtttgtatagtctgtctgtccccactccatcttaccattaaggaactttgtaccatcatccgacacaacccactgatgcgacaacatgccttgggataagtccattatacttatatagttattaagattcagctgaataggtgaaacgttttcctgatctgtactcacatgccaggtacattcagccacgttattcaacggttcaaactcatcatccttacaagatgtcagaaccgagattaatgaaagagcaatatataaaaatctatttttcatcgtatttatttattaatatcaggatttgatgtaatttctatatttggaataggccagtatgccacttgcggaccgtagttcaatgatgcttggaaataatccacaaaagcgtttcctctcttttctggcggcagctcataaaatctgtactgctttccaaagttgaatgctgataccaaagcattagggtcatcaggattaggcttaagatatttggtctgaatcatacagtacttatattcgtcggatgccaactgatcaaacctttccttagttatattccagcgtctcaaatcaatgacacgtatggcatgtccttccatacacagttcaagaggacgttccacatacatcagatgattcattacatcacttgcagcatattccttctcatcgtatgtatatctcttgaattctccctgttccgattttccgataagcacaactccagcacggtgacgtaccttgttgatggcattgatagctgactgaacatttccatcgcttgcaccgcctttaatcagacattctgcatacatcagatatatatctgccaaacggataagacgatagtttattcctgaggccatagcaggcttaaattcagtttcactcttacgtgtatcccaatttgataattttctgaaatacgctgaagagccacggttgaattttgatacctgttgtgggagagactgataatatatcagactttcatcgccgtttattgcaagagaggcagatgcacgcatggaatagcttctgaggcgatatgcctgaccgtcttcccatttaaattccggaactatgtcatcgtagccggtaatcttattgtataaaactttattatctccgacagttgagacgagtcgttcgcgtactccaacatattttcctgctgttgcatcccacgtataaacgtacgttctgttatatacgacaccctgacggtccacctgcgagctgaaagttgttcccaactggtcgtatataatatccctatgttcaggatcaccataattgtcggactgcatttttatccagttacgttcatcaagtctgtccaccggctctgtttcgaatgcttcaacaagccaaaaagcaggaacagtgttaagccaggcatcgcccaagccatttacattcattccccatatattatataaggtagactccgaccatgtaccgaattctgtattatactgtgtagaataggaaacctcgagaatagattccgaattgaattcattggcagcagtaaaattatcgactatgtcatcaaccaaagcaaaacctccattatcaataatatccttaaaatattcggcagctttattatactctttatcataaaggtagcttttgcctaatattgcctttacagcccaagaggtgatacgtcccaaatcggttttctcccatttgtcattcaagccaaggtcaagagctttctgtaaatcttctctgtaatatttcttgatttcatcacttggtgtaacctttttatagtaatcttcttctacctctgcaatttcattaatataaggaacattaccattattgaatgaattattgagataaaaataaaacaagccacgcaaagaatatgcctgtgcctcaatctgagcaagcttggttatttgaggttcatctgtaacatttggacggattttctctatactggccagaacctgattcgcacggaacacaccagtatacagtgcagaccatttaccacggactgttccgtatgaatcattaaaggtttgcttataggcttcgttatcaaactgctttctgtccttattaccttcaactgctatatcacttctacggttctcatcgagcggatgataaatattggtatttttcaaagcattatatacagcagccagtcctttctcgcagtcgcctattgttttataaaaattctgtgttgtcagctgatgtatgttttcctgcgtaaggaaatcgtcgcatgaaaccaatgtcatgcccgacatcaacagactgaatactattgttttatatctgaagttcatatatttatattattaaaagttagaaattaatctggaatccgccacgcatctggatacttataggatatgttccatagtccaaaccacgacgtgacaatccattactaccgacctcagggtcgtatccgtcgtattttgtcagtgtaagaagattatcggctgcaacgtataaacggaacttgcccaatccaagctttgatacccaactcttggggaatgaatatcctaacataatatttttaagtctgacaaatgaaccgtcctcaatccacatatcagtatgagcacgatagttgttatgcccctctgtacgataagaaggaatggtagaggtatagttggtaggggtccacatgtatatcagttccttattggttcttctttgatatgtatatatcttcgtaccgtttattatttcatttccaactgaagcataccagttcatagagaaatcgaagcctctatagtcggccgagaagttcaaaccaagttcataatccggcataccactaccggcataaacacggtcgtcatcattaagaacaccatcattattggtatcgatatacataaggtcacccatacgggcacttgactgtaatttctgatattctgcaagcttctgttcagtattgattacccctgcggttggcataacaaagaaagcaccggcttcatatcctttcttgattgcagttacataatcacttcctgatgaaacaggtttaccgtcggggaagaaatataactcattttttcctgccatagacacaatctcattcacgtttttggtaaatgtaccagtcaagctgtaattaacaccacgtattttgttgcggtgagtaagtgaaaactcaacaccacggttttccatatctccggcattcaatgtaacagttgaactctggccccctccatttgacggtggcacgaccatcgggaaaagcatattcttcttgttactcttgtacaaatcaagacctaagataagcttgttattatataaagccatgtcgataccggcattaagctgctgggttgtttcccatttcacattcggattggcaaatcccaattgggtaaaaccatttgcaagaatttcggaagttccggtaccaaaagtatagtcgtagtttttgtatatagctggtgcgtatgaataatcagggaagttctgattaccggtagtaccatagctgaatcttaattttaacgaatttactagccacctgaatctgtcgaagaatgattcctcagaaatattccatcctacagacaatgacgggaacaatccccaacgattttcttcggagaacttagatgaaccgtcgcgcctgatactggcacttgccatgtatttgtctgcatagctatattgtagacgacccaacataccaaccattgtactgatacggtcctgtccccactggccactgcctgtacccacagtcatatcggatgttcccgcatttaggttcggaatctcgttagtaaccaaatccattatactggcatagaacatctcgtatgtatatttctccatactgaaaactccggtaaatttaatatcatgcttttttatcttcttattataatttaccattgtttcccaagtgagactggtattctttgaatgagtatcttttaattgcgaacggtaattagagctggttaccttttcgcctttctgattatatacctcaaactcaggtcgaattgagacagctttctgattgttatatccaaagcccaaacgtgtggaaacattcagtccgggaattacattataagcaagataaaaattaccgttaaatgattctgtgtccttatgattttcctctttcaatcttcccaatgtataacttacgccctgtaaatctgcaggatcgccagctgcatttactatacttgcctgtggataaatctgagaacgagtaggcgagtagtcataacattcgttcaataacccccaagccggagataactggttttctatcttcatagcgatgttagtgttgatagtccattttccgcgctgaaaatgtgtattcgaacgaatattatatcttttgtaatcggaatttatcaacacacctttctggtcgaaatagttcgcggtaaggttatatgtcaaatctttcttgccgccattcgcagtaacagaataattctgtattggtgcgttattattgactacatattcatataaactagagttgttgaagaaattcacaggatatgttttcagattagaccaggccaggtcgtctgtattctggtttccttccatcattctgttagacatcacttttacaaatatactctcgttggcatcaagcaaatgaatattcgaagtaatgtgctgtacaccataatatccgtcgacagctatcttcatttctccttccttacccttctttgtggtaataaggataacaccggaagcaccgcgagtaccataaatggcagccgaagcagcatccttaagaatatctatacttgctatttcgctactactcaatcccgggtcgccctcgaacgggacaccatcgacaacatataaaggagaactgtcgcctgagatagaacttaaaccacgaatctggatgttggatttggctccaggctcaccagaacttgcctgaacgttaactccggcaaccataccctgaagagctgtacccaagtcggaagtactgatcttagtaatctcatctgagtttacacgtgccactgcacctgtcacctcttttttacgcattgagccataacctacaacaaccacttcatccaacacttttgtgtcttcctgaagcttgatattataaatctgaccattcttgattgcagcttttacagttttatacccaacaaaactgaacactaagttacctttagtcggtaccccttgaagaacgaaattaccatccatatcagtaatagttccaagagaagtaccttcaacttgaacagctgcgcctataacttcaaggttattggcagcatcaatcacctttcctttaactgttatcttctgtgaatacatagacaatgtatagaagataagcatcacgaacaacatgtacctgccatggtaccattttttctgatttctcatttgtaaaaattttaatttagcaataggttatgaaattccttttataactgacgctaaattatttatttataatggtacaaaaggggagaattatatatttaaaaagggggtaaaattttacccccacttatattaagaatccaaatcggtctgtatactctgttctttgtactgttgcggcaatacaccgaattctttcttgaaacattctctgaaatacttcaaatcattgaaccctacatcgtatgtcacctctgatacagaataccgtcctgtcttcaacagttctgccgctctcttcattcttattgaacgtacaaaagcattggctgttactcccataagtgctttcagcttcttgttcagaaccaaggccgtcacgccaagacctttacatatatcctctatctggaacgaagagtctgtaatgttgtcctctattatctttacaagtttctcaaggaacttatcgtcggtagatgtagtgcttacctcggaaatctttattgccggaactttcttgtgttgaagaatccgcttcctgttggttataatggaattaagcagctctttcattatcttgttgtcgaaaggtttagggcaataagcatctgcatggaatttatatccgatgaaataatcctgcaatgtagtcttggctgaaagcaatactacaggaatatgagatgtccttacatcctgcttgattctctcacacagttccagaccattcatgcccggcatcattatatcggataaaacaagatccggttgcaaatctggaatcatgttccatgccatctccccatcatgggctatcattatcttatacttatccgacaacagtaatgacaacatattacatatatccttattgtcatcaacaatcaatatagccggagattctccgtccacttctatgtctatcatctcttcatgctcgcacgattcacttcttaacacatcagcaaacttttcatcctccccactgttggcagagatattctccgtaaccatgtccccctcagttatcataggaattacaacatggaaaacagtgcctttaccttcctctgatacaaacgtaatatttccattatgtatctctacaagccgcttggtcagaaacagacctataccggtacctccttcagcagagtttttattctgactgtagaaacgctcgaagaggtgtgttttcaggttgtcggatattccgtttcccgagtctgccacagagatgtttattttgttatcctgttcattgacagtaaacgatacaaatcctccggcaggagtatgcttaatggcattcgatacgagattatagattatctgttccataagatgagggtcgaacagaaagcttatatcactgcgtgagacagaatattccagccctacacctttctgttttgcccaatacgtgaactgctgaaatacttcttttgagaaagacgagaagttgccatatttgagattcagactaagcattcctttctcgctctttgagaagttcatcagctggttgacaagacttaacaggaacttactgttatgctccattgtctgcagcatgccggcaagatacttgtcggacgaatacttgcccgattcaataatcatactaagtggagaatgaataagtgtgagtggtgtcctcaattcatgcgatatgttggtaaaaaatgtagtctccttttcaagaagttcttcagtcttgcgtttttccatgtttgctatatatagagcatttctgcgctgcacccgtgaggtataatacaccttgaaccggtataaagacaagacaagcaatataaaatagagtgtataggcataccatgtacgccagaaaggagggttaataatgacaggtatggaaagttcattcaaactgtagactccatcgctattcctgaccctcagtctgaacatatattcgcctgaaggaagctttgtgtagaaagcctcacgatgaaaagcggaggtggaaatccatgaatcatctacgccttcgagcatatattcgtaaccaaccttataaggacttctgtaatccagggagctgaactggaatgagaaagtgtttaaattataaggcaattcaatgtgctctgtaaaacttacacttttgtcgaaataagctgaatatgtggaatctgcctcaacgctgtgattgaagattttaaaatcaacgagtgtaggactaccgttgaaatctatcacatcaaagtcattaggtctaaagacgttaattccgtttacgccaccgaatatcattgttccatccgtcattactccagcagaaagttccataaattcataatcctgaagaccatcgaaaatatcataagatcttattctctgtgtgttgatattcaacgaattaattcctttattggtagaaatccataatgttccatccgtgccattaacaattgattttattgtattgctgctcaacccgtctgcagagctaaaattttcaacgcaggcattatggttttcatccaaatccacgattttccttaacccacgtccaagtgttccataccagatattatgattcaagtcttcacatacaggcactatatagtcgagttcatcaagtcccttgactgagttcaaaacaggattatctatatacaaatctgcagattccaatactttaagaccgaagctggaagctacccatatattacccttatgatctttaatgatgtttcttactatcttaagttctttattgtcagatgttttgatttccttcatcacacctgtggacaaatcatatctgaaaagacctttattatatgtgccaatccacaaatattttccatcggcaagcattgcgcgcacatttctcaaacctgagatctttttataatcattatcagaagtgaaactgtaaataccatcgtacatcagagacacatacatgcagtcggtgtagtttgagtatgctgttgagtatactatcctgtttgccgtgaaaggaataagtctggcattaccggtaatggaattaaaatgatatagccctgagccttctgtgcctaaatatatatcagatttggcaaatgtataaacggacgatatatgatcatttcctattcctctgaataaatctataggtttattattttcgcgtatactcataaagccactcttgaaaaatcctatccaaagaatatcgtttttatcaagaactacagtttgcggatagctgtaagaatatgtagcaataacctgtggttttgactcgatggcatgcaatacatcaaaagtcaacacattcacagtgcttgtagtggcataaaataatcttttgtttttatataccatttttcgtatatcacagttttccaacagggtacttaccttgcaggtatgcttgtcgtataaacataattgatgattttccagatttgagtacaatatttgagaagatgagatgactatggctgaagctatagggcatcccaatagtttgttaagcagtaattcatctccatcgacgttacattcgtacaggccgtcttcggaggagagcattatcgtattatctatttctatgatgtcggaaatgtatggtaattttaatgttgatcttaagacagtatttattttgccattttgaaaatcataatttacaaggtatatactttcatcagaggaatgaaaccagactctgtctttagagtcgacaagaatcttatcgcaagtgaaatttttatcaataccgctgtgaccaagatttaatgaaacgaattcgttctttacagaattgaacaggaacactcctctatcggctgtacctatccacagatttccatgtgaatcttcgtcaatacatactatcagattactgttaagaccgtttgactgatatccgtaaaccttaaattcatatccgtcaaacctgttcagtccgtcgttcgtggccaaccatataaagccttttgagtcttgataaatacattgcacatcattttgggaaagtccatcaagagtagtgtactttcttgtgacaaactcattggatgcaaaggatttgcaaactataatcagaactgatattaaacttaagattaatctaaacatataactattattctttatatttcatcaagattacaaagttattgattttatctaaaacatcaagtatttacagtagttaatagataattatagatattttccactttagaatgcgtatcaaaatcaatcaagaaaaaaataaatctttaacttcatttcatagtataaaacaaaaaaagcatcgtaccattacactcaataatagatacgatgcccgaaagaaattacagtaacagactgtattgggattgttcttaaaaagacttatctgtatgactttatatatatgtcgagtatttcggtatccgacagttcatgagggtccagactgaacaatgcacccatggcagttcgcgcattatcaatcatcttagggaaatcttcctttactattccccagtcgctaagcttcaaatcgcggacattgcattccttctgcattctcaccaaagcatctataaaatgttcgggattaaggttcttgcatccggtcataacatctgccatgcgcatatatctctttgtcctgtcataaataaaagtagagaaataggcctcgcttatagctatcaggccaacaccatgaggaagagcgggatagtatgcgctgagagcgtgctcgagagaatgttcggaagtacaactggatgtggattcaaccattcccgccagcgtacttgcccaagccacctttgccctcgctttcaggttatttccatccttcaccgcaacaggtaaatatttatacagcagtctgatggcctcaagagcgaaaatatcacttattggggttgcacaattggcaatatagccttcggctgcatgaaagaatgcgtcgaatccctgataggcagtcagatgtggcggaactgaaaccatcagttccgggtcgattatcgacagacatgggaaagttaaagtggagccgatacctatcttttcgtttgtttccagattggttatgacagtccatgggtcagcctcggttccggttccggctgttgtaggaatggctatgatgggcaatgctttgctgtaaggaagccccttgccggtacctccttcaacatattcccaataatcgccatcattacatgccatgattgcaatggatttggccgtatctatcgaacttccgcctcccaaacctataatcatatcgcaattttcctcacgacagattgccgtaccttccattacatggtcttttattgggttaggcaatatcttgtcgtacaccacggcatcaacattattttctttcagcagaccaatcaccttatccagataaccatatttacgcattgatgttccggatgaaatgactatcaaagcctttttgccgggcaatgtctctgttgaaagacgtttaagttcgccacatccgaagagaatcttcgtcggaatattataaccaaaaacaaaattattgtccataaatattatcagtcagtcaacttactatcttaaagcctcatcaatcactttcttgagttcaggataagcctcatctgtatcgcccacctgttttctcaactcacgcagtttctttttcatgtccttaagaactttggcgtatttaggattatcagccaggtttaccatttcgtaagggtcgttcttcacatcgtagagttcgaaagaaaccggagtaggaacaatcttgtggctgttcttcaaccatgacattgatttctgtccgtaacgtttgtcgtcgtaatgacggccatagaaaagtatcagcttatagttttccgtgcggatacctatgtgtgccggaacgtcgtgatgaatcatgtgcatccagtatctgtagtaaacagcatccttccagttttctggctttttgccttcgaacacagaggcaaagctctttccatccatgtatgaaggttctttgccaccgaccatctctataagagttggagcaaaatcaatgttgttaatcatcaggtccgacttggctcccttgtaaggacatctcgggtcgcggactatgaaaggcattctttgagattcttcatacatccatctcttatcctgcagatcgtgttcgccaagcatcataccctggtcgcctgtatatacgataatggtattttcccagagtccttccttcttgagatagtcgaaaagacgtttcaggttgtcatccacaccctttacgcaacgcagatacgatttcaggtaatgctggtaggcaaggtatgtattctccatttcatcacctgtattgcacttatattccattacataattgcggatttcatgacggcttgagacagaagttccgatgaagtgacgaagtgaatcgttcttgcctcttgtgccttcggagccccatttgtctgtatcgaacaatgacaatggaacaggcacttccacatcgtcaagataatattcatagcgcggtgcgtactcgaacatatcgtgcggtgccttgtaatgatgcatcatgaagaaaggtttggacttgtcgcgtctgttcttcaaccagtcaatagcaaggttggtcacgatatccgaggagtaacccattttctttatctggttattaggccatttcttgtcagttacgtcacttgtaaggaaaatagggtcgaagtattcgccctgtccgccatgaccgttgaatacagaataatagtcgaagtgcgacggttcgcatcccaaatgccatttaccgatcatggcagtctgatatcccatattatggaactcatcaaccagatattcctggtccggctgaagcacttcatccaaagtgagcaccttgttacgatgggaatactgtccggtcatgatacatgcacggcttggggtactgatggagtttgtacagaaacagttctcgaagagcataccgtcccttgccagttcatcaattgtaggagtagggttcagtactgcaagacgacttccgtatgcgccgatagcctgcgaagtatggtcgtccgacatgatgtagatgacattcatctgtttctgctgtgctgcgacaccaacacatacagacaggaatggcataacagccattcccttcattatattattttttaaattcgttttcataagtcagattatcattgaaatagaacttgcaagacatatcatcgaatgattttacgtccttattctgcattttaacccattgttctgatttagccttgacagcgacctgagttgaaacctcattaccgtcgactacacttttaagagtgacatttgcatcctctgcattatggtttgccacacgtacagtgataaggcatccgttatcaaccttatcgtatagcggtttggaaaccaccgcccctttaagcttaatcttgaacacatgtgcatattcagtaggtttgttcttagggaagtttactacaagaccctcgtcagtcatcttatagtcaatcttctctgagcttccaagcatttcaaccgactcaatttccacgttctggcaatacttaggagcaaatgacttgatagtaacactaccatctgtccaagccagagacacggcatagaggttattgtcgcgtgtagtaaagcgaatgtcgtccgctgtatattcagtttttgtattgtctgtcatataacctgcggtgcctgcgttatgtccttcgaaagcaatcacccatggtcgtgagccataaatagcctcaccgttagtcttcaaccatttacctatctcggcaagtacgttcttctgttcgtctgtaatagtaccgtcggccttaggacctatattcagcaataagttaccgttcttgctgacaatatcaacaaagtcgtcgatgatatggtcaggactcttgttttcctcgcccacacaatagctccacgatttcttgcctacagaagtatcagtctgccatggatattcacggattctgtcgctcttacctctttctatatcgaacacctggatattgtcgccatatccgaatttagtgttaaccacaacttctttattccaatcaagagccgaattgtaataataagccatgaatttatagaaagtaggctggaacggatattttcccacagtccagtcgaaccatatcaattcaggctgatatttgtcgataagctcgtatgtatgcataaggaactgacggcgtgaacgttcgttcgagccttcatacttaccacaataaggtgtcataccctgaccttcgggctcatgcagtctttcgccatacagagtgattgtagtgtcctgaacatcagaaggagtttccattccatattcatagaaccatgcattctcgcatctgtgagaagaaagtccgaaacgcagaccggctttcttggtagcttccttcaattcgccgattatatcccttttcggtcccatatccacagcattccacttattgaaagtactgctgtacatggcaaatccgtcgtgatgctcggccaccggaacaatgtattgtgctccagatgattttaccactgccagccactcgtcggcattgaaattttcggctttgaacatagggatgaaatccttatatccgaatttggtcaaaggaccgtaagtctgtacgtgatacttattaataggatgaccttccttgtacatccagcgggaataccattcactgccgtatgcaggaacggaataaactccccagtggataaagataccgaacttggcatccttaaaccattcaggaatagtgtaattttgagcaatcgatgccgaatcggccttgaacacatcagtaccttttaaagatacagtagaatctacattaggagcgtatgtagaattgcacgacgccaacaggcttaatgccgcaactcctaaaaccgttttcatggatttcttattcataataatcttattacattaaataatgacattaattttttctgtaagcaaagatacacttgagttccatttacaataaataatttaattactatagtaaggggtaaaatatttaccacctattattgaacaaatttaccccctctcatatatgataataaactgccaatatcgaattacaagtaaatatatatttcaacaaaaaaggtttagcctattattacacaacaatttcaccctaagaataaaatatatatagagtaaatttgccaatataacaaactgtaaaaacaaatttatgaaaaactatttgatttacttactcgcagcagtatcgtgtacaactgtagcagacctaaatgctcaagtcagtacaaaaacaggtaatgaaaccacagaacttacaattccgaaaaagttctacaaggacagcattgatttcagcaatgctccgaaaagacttaacaacaagtaccctctttccgaccagaagaacgaaggcggatgggttctaaacaaaaaggcctctgacgagttcaaaggaaagaagctgaatgaggaaagatggttcccgaacaaccctaaatggaaaggaagacaacctactttctttgcaaaggagaatactacatttgaagacggctgttgcgtgatgagaacttacaagccagcaggatcactgcccgaaggatatactcacactgccggtttcctggtaagcaaagaacttttcctttacggatatttcgaagcaagactgagaccaaacgactcgccatgggttttcggtttctggatgtcgaacaatgaaagaaactggtggactgaaatagacatttgcgagaactgccccggcaatcctgccaacagacatgacctgaactcgaacgtgcatgtatttaaagctccagcagataagggtgatataaagaaacatatcaacttccctgccaaatactatataccattcgaattgcagaaagactttcacgtatggggacttgactggagcaaggaatatatccgactatatatagacggagtactgtacagagaaatagagaacaagtactggcaccagccattacgcatcaatcttaacaacgaatcgaacaaatggttcggagccttgccggacgacaacaatatggattctgaatatctgatagattatgtaagggtgtggtacaagaaataagaaataacataatctgaaattataaaaggcagtcttcattatcagtatgctgatgataaagtctgcctttttaacaagaagataaagattttaatctgccctatcactcatttacttcatccggatactctgtaagcgagtttcccgaattgcttatttcaatagagccgataggaagataattgaacttcttgctccatgcagagataccataatctcttctaagaataggcatcatgacctcctcggcacgtcctgagcggacgaggtcaaaccatctgtcaccctcgcatgccagttcacaacgacgctcataccatagaacatcaattacgcttttaaatctgtcaggatacatctgcattagcttgtcaacatcaatataacttccgtcgtctgcatgaacatgcttctttctgagttcatttatgtaatacttcgcttttgcttcatcaggattagtacctctgagatatgcttcggcaagcatcagatacacttcaccatatctgatgacccttacgtttccaggcttgtttagattggggtttcctatcatatcgtaatttttgaaaggaggatatttcttctgggcatatccctggaaatcaggcccgtaagagcctgtctcccaaacaactttttttgattcatcctgaatattggcattaggtttggttacaagttcatcgtaagtaaatatcgccgcatcacgacgcacatggtcatccggaaggaaataatcatacaattccttagtaggcagacaaaagccatatccattatcataatcaggactatttttcaactgtctcggtccgcagaaagtcacccacatagcaccttcgcctgcatcaatattaccccagtttgtattaccagatttggtagaggtctgtatttcaaatatagattcctcgttattctcctgatgagccgcaaacaatttagaataatcatccgtcagagtataattaccacttgaaattacatcctccaataaaggtttcgctttgtcaaaaatcttagcatcatcgttgctccagtcagcccaataaagatagaccttggccaacagggcttgagccgcagtcttggtaatacgtcctttcattgtgtccgggaaattatcctttagagaagggatagcttcaagaagatctttctctattgctttatttacattttcgcgagtatctctcgtaaacttgaatccttcaggataaagagtctcaagactgataaagcatggaccataatatctcaacaattcaaaatgataccaagcacgtaagaacttagcttcagctttataaactttagcttccggactgtcatactctgaatttattacaagattacatctatatataccacggtaacgagttttccacaaattatcggaaatagaattgacactcgtatttgaataatcctctatagcctgcatgtaaggctgatcctgatcagagccaccaccagtacgagcattatccgaacggatttcacccataggtacaatggaagcaagtgcattacccgaagcaccacctatgtgagctaacggatcataacaagcagtaagcgctttgaacatctgttcatcggtcctataaaaagaactttctgtttcggacattataggagctgtatccaggaaactgtcgctgcaagatgatgatgcaatagcagcaaacatgaggacaagaatattattatgtattttcgacttcataattttcaattttagaaattaagacttaaaccaaatctgaatgtacgggcctgagggtaagtaccatagtcaatacctgtgctaagaatattgccacctgccatatttcctacttcaggatccataaacggatagctggtgaaagtggcaagattatcaattgctgcataaattcttgctttattcagcatcaacttgtttattaatttagttgggaatgaatagcctacctcaagtgaagaaatctttaaatgcgaaccatcataaagataaaaatcggatggtttgccaaagtttccattaggatctttggatgaaagacgaggcactccattatcatcaccttctttccgccatctgtcaagatagaatgatggaaggttgctgcgtccgtatgcttcctgtcggtaaatatcagagaagactttatatccagcttttcctgttaagaagattgtcatatcaatacctctccagtcggcacctaaattcaaaccgaatgtccattttggccaaggattgccacaatcggttctatcttcatctgtaatctgcccatcgttatttgtatcttgccatataaagtcacccggaacggcatcaggttgtatcactttaccgtcttttgatttatagttctgtatctgctcttcattttggaatattcctaagttcttataaaggcggaaataacccatagcatgaccttcctccatacgcgttacattaacagatgttctccagctaccaccatcagtatatccatttacatttcctatctttacaacctcatttttaagatatgaggcatttgcggaaatagagaagttgatttcgttccaatttttattaaatgtcatctgcatttccacaccctggtttgttatattaccaaggtttctaaaagctgcattattacctctaatggcttcaactgttggctggaacaacaaatccttagtactttttttaaaccagtcgaaacttgctctaatcataccattatagaatgtcatatcggcaccaacattaaattgttcagaagtttcccatttcacgtctggattaacaaggttattaggagcagatcccacagtgatggcattaccaaacgtgtaattataattattgccaataatagaagtataggagaatggagaaattcgctcatttccgttctgtccccaagagaatctaagtttgaagacatcaaagttcttaattttccagaatttctcatttgaaacattccaacctaatgaaacgcccgggaaagtagcatatctgttattgggaccgaaatttgaagacccatcgcgtctgaccacaacttccgccatatatttttcagcataattatagcttagacgagcaaaatatgagaacatactatgtctaggattagcaccgccactattagctgatgtcataacatcaccagcattaagataccagtaattctcattggtcattgcttcatttggatatttatttcgtgttccggccataaactcataaacatctcttgatgcagaagtacctaacaggacagatgtagaatgttcaccaaaagattttttatatcgcaatgtattctcccactgccaactactattagcatttgtactttgttctaccctagaattatcttctttacattctgcagaatgaaaaaactttggtgcaaacattcttccacggaaattccgatgattaataccaaaatctgtgcggaaaacaaggtctttaataaaagtgatctcagcataaacattaccaaaaaattgctgggtaatatttttattcttaggtgcctcatccataaatgcaatagggttccacatacggctataaggtacaggagagactccatatccgaaagtatcgttgctattctcatcataaaccggagtagtaggatcaatattataggcgtatgatatcggattataaccattgataccggttgccactccactattctctatatatgcatagttgacgtttgcacctacacttaagaaatcatttatagaataggaactgttcagccttgtgctgaatcgtttgtaaaatgacgcatcttcaccgataataccattctggtctagataattcaatgaaagcaagcttgaacccttatcactgccaaagttagcagtaatgttatgctcagtaacaggagctgtattcaatatttcattaaaccagtctgtattataacctgttggagcagtaggtacaccaccggcaagcggcatatcatcattgtcggcaaactctttcatcagcataatgtactgttcatcattcagcatggttggtttctttgctactgtagagaaaccatagtaaccatcataagcaagcgatgtctttcctttctttcctttctttgtggttataaggactacaccattagcggctctggcaccataaatagcagctgaagttgcatccttcaagacttccatgctttcaatgtcgttgggatttacactgttcatgtcgtccataggcagtccgtcaattacaaaaagaggattagagtttccatttgtaccaacaccacgaattaccagcttcggtgctgttcctggctgaccggaatttgtcacaacgttcacaccactaaccctaccgctcaatgcattcacggcatttgctggtttagattgcaataaatcatcggaatcgatgctactgatagcacctgttacaacactttttttcttaacctcatatcctattgctacaacttcctcgagtgcaatggcagatgtttttaattgaacgtctatcttagactgacctttatacactatattctgtgtatcatatcctacgaagctataaatcaatgtcgattccattggtacattttccaagatataatttccgtccaaatcagaaataataccgtttgtggtacctttaactaaaatacttgcacctatcacaggtaaaccatcggagtctgttatacaaccggtaactttcccgttctgtgcatttaatggtaaactgaacgttataagaatcagcatacacattaatgatagtgttctgttcataatctagagttttttgtaattagtgtttttcttaaaataaaaagttttgttctatcagttgcgcgctacttactgacacttgcaaatatatatactatgtaatataaccaaagggggaaaatttcatttaaataggggggggaaatagattaactaaatattttaaggaaaaatggctgttagaatccattcccagactccaacagccattttatcactaacaatcgcctgttaatcaatatatttttctgcccatttccttaagatttgcatccctgcccagtggaacaaaagtaaatccgtatgaatagcttcccttcagaagacgcttgtctattgaaggacgggctttcagactccagctatctgttccgcccactccagcctgaaccaggtcgatattaagagtattagaatacaagtccttttcaagttcatttatatgtttagccttatcaatcgcattctgcgacatctcccacactgaaacagataggggttcatcgccgacaatcatcacacctgccttatccgactgcaaggcaaaccatctcacgtcacaacggtttccgttttcctgcggcattacatagtcaaatcccagagcggacaccttgcagttatatatagacaccattgcagaggcttttctgtcggaatagttttcccatgggccacgtccataatatgtcacatccgacaaacgattggtacattcgcattgcaatcctacgcgcaacatttctgatatttcaggagacttcatcattgaataatgaacgcctattgttccgtctgcttttactttataattcaaggtaagtctcagtctttcatctatagcctttagcaccttaacctcaagattgccttccgatttgcgtacatctatagaaactgtctttagctttaatggagcatctttccagaatgcaaacagtctatcgaccttccatcctcgccagtcattgtctgttgacgctctccagaagtttggtttcagagcagatgtgatgatactttcattatctatcttatactgactgatataaccatcactgatattcagataaaagttctttcccttcacgctgatgtctttcttgttatctgaatcgatttccatatccaatgtagtatcaacgcattctactatctttggtaaagaaagatacttaaactgttcccaggcaacctcgtatccagctttggcatacagattgtcattcttgagcctggcactcaggaataaccaatattccgcaccgtcatcggccttgaaattctgaataggaagttttagtttacagctctcaccagctggtgttgtcggcacaataatctcaccttcctgcaatacactgtcttcgtccttcaattgccaaaaataacgatactcatctgttgaaaggaagaagtttctgttttttacagttatctctccactatagacattatcagttgtaaatgatacaggagcaaacacgtacttgcattcctcagtagcaggtttaatggagcggtcggcactgataacaccatttatacagaagttttggtcgttgtgctcccctttctcatagtcaccaccataattccatgatttcttattatatttccgttcattatccagcaatccctggtctatccagtcccaaatatatccgccggcaagcgcatcatgagaacgtattgcatcccagtattctttcagcccgccggtagagtttcccatagaatgtgcatattcacacattattatcggacggttcatgaccggattcttagtcattgctataagctcatcgaccataggatacatacggctaatgacatcgacgtataaaggatcatcgggattggcatacacacaaagctctttctttgccggtttgacatcttcgttcacattaaaatctatctcactagtaacgattgacgcttccttacgtccgataggtttgtataaaggattttccggctgtccttgcgccccctcgtaatgaacaggacgggttgggtcataatctttcagccatcctgacagagctgcatgattagggccgcatccagactcgttgcccaacgaccacataaacacagaaggatggttcctgtctctcacagccattcttaccactctctccatgaacgagttagcccactcaggcctattggacagataccccctttgatgatgagtttcaagattagcctcatccattacgtatataccatacttatcgcacagttcatagaaataagggtcgttaggatagtgcgatgtacggactgtattgaagttataacgcttcataagcagaacgtcttcgagcatctcatcacgtgtaacggtcttacctccggtctcgctatggtcatggcggtttacaccaatgagtttaataggagtgtcattcaccagaatctgattacctgttattttaatatccctgaaccctaccttattacttctcgcatccaccacgttgccctttttgtctgtgagctttataaccaaagtgtatagataagggtgttccgaattccatagttttggcttagaaacaattccctccatcattccgtaataaacattatcacgctgaggataaggttcgttcaccacataatcggcagtaacggtaatgtcttttccaaacaccggtttcccatcggcatcatataattgggctgacagattccatcccttcaaatcatccatattctgatttgttatttccggacggatctgtaaccgtgctatattcttccggaaatcgatgcgtgtccttactccataatcatatattgccacctgcggaatggacatgatatatacttcacgatggataccagccattcgccagtggtcggcatcttccatataacttccgtcggtccacttatacacttgcaccgccagtttattctcccccttcttaacgtattcggtaatatcaaattcagtaggcagacaactgtcttcggaatatcccaccttctgtccgtttatccatacattaaatcccgaatagacgcctccgaaatggagtataatcctgtcgctcttccacttgtcaggaacaacaaactccttgatataacaccccgtctgattattcctgtcaatatatggcggacgagcagggaaaggataaatagtatttgtatatataggatagccatatccctgcatctcccaacatgaaggaacaggaatagttttccatgatgatgaattgtactccactttataaaaaccggcgggagccaatgccatatcctcggaaaagttaaacttccattggccgttcaacgacatatactccgatttctctctgtctccatccaaagcccaatccactctccggaaagaataagtagtactgcgggaaggcaaacggttaattccgtttatggtctgatcctgccatacattctgattgtttctccactgattggcaccgttgtccgatgcagacagaaattgcatcatgaaaaataacacagaaaatgaaaaaatagattttaagttcaagttcataaattcgcattttaagtttctatgcaaatatataagtataacgaacaatgaatagggggtatttctatctatatagagtggtatttttacatatgagctaaaacttaaaaaaaactgtcagtattactatgctatgtagcactctatatgaaaatattatatattcccaagtcaaaagccttttcaaacaatttttatatattctcatcctatcccttccatcaaagataaattccaatcctgatttgccagccgcatttattccttttttcaggagaattttctttatggctatcgccatgaaaattcacctgaaaaagaatgcggcggcaaacggattagaattaaagaaaagattacagggattaactgcgaccgacgtgacgcatagccgtaattcaaaggcggctatccttatattccatatatgacctcacaaatactgtgaaaatccactttccccaataacaaaacatagcctgccatatcaacacccaaaataagacagggatttcaactccctccgatctgcatagtctggtggcttcgctatgcttttactcctacatccattttttttctttcttttttcctctgttcccgttctttcctatccttcgtgtgacatttgatgacacctgatgacatctaatgtcatctatttgtaaatcaattgtttactcaatttatcatcttacatttggactgtgaaacaaatcaagtagtcactcaaaacaaaagattatggcacaagaaaacagtcctgacaaggaaaaaaggcaaggccggacaaagaaacccgaaaagccttatgtggaacaaattgacgagcttctgctggtacataacaagaatgacccaaaggaaggtttgggagtaatcagcaagatggacgagaaaggcaattatcagacggttacaccggaagagaagaatgagaactcattcctgaaattcgacaagaattcgagtattctcgaaaacttcatcaagaatttctggagccagctgaaggagcctacgcatttcaggcttatccgtatgaccttcaatgattacaaacagaacaaacaggctctcaaggacctggccgaaggcaagaagacagacgcggtaaaggagtttctgaaacgctatgaaatcagaccgaaagtaaacaatcagaaaaacagtcaaacaaaagaggaggaaacaacaatggcaaagaagcaggaacagacaacgcaggctcagcctgaacaggtatcacaggtggaagctgccgcacaggggcgcgaacagcaggaaccgcaacgccagcagacacccacgtaccgctacaacgagaacatgattaattgggaggaactgggtaagttcggtatatccaaagaaatgctggagcagtccggacagcttgacagcatgttgaaaggatacaagaccaacagaaccatgccgctgacactcaacattcctggggtactgaccgcaaaacttgatgcacgcctttcgttcatatccaacggcgggcaggtcatgctgggcatccacggtatcagaaaggaacctgaactggaccgtccttatttcggacatatcttcacggaagaggacaagaaaaacctgcgtgaaagtggaaacatgggacgcgtggctgaccttaacctgcgtggcaacacgacagagccgtgtctgatttccatcgacaagaataccaacgaactggtagccgtacggcaggagcatgtctatatcccgaatgaaatcaaagggataaccttgactccggacgaaatccagaaactgaaaaacggagaacagatattcgtagagggaatgaagtccaatcaaggtaaagagtttaatgccaatctgcaatatagtgcggaaagaagaggcatcgaatttatcttcccgaaagaccaggctttcaaccagcagacgcttggcggtgtaccgctttcccccatgcagctcaaagcgttgaacgaaggacacaccatccttgtagaggatatgaaacgaaagaacggcgaactgttttcttcctttgttaccatggacaaggttacaggcgggctccaatatacgcgccacaatccggaaacgggagaaatctacataccaaaggaaatctgttcggtacagctcacaccggaggacaaggaagcgttacgcaaagggcagcccatctatcttgagaacatgatcaaccgtaaaggtgaggaattctcgtcattcgtcaagctggacctggcaagcggaagaccacagtattccagaactccggacggtttcaacgaacgacaggcaccagccatcccggctgaggtttacggacacctgctttcggcacaggaaagagctaatcttcaggacggaaaggctatcctcgtaacgggtatgaaaggtcccaacggcaaaccgttcgattcctatctgaaagtaaacgcaaacaccggacagctgcaatatttccaggaaaatccggatgtgcgccgcaatacttcacagcgtgcttcacagactgacaatacccagcagcaggaacagaagaagggagcaaaacaggctgtctgacctgaacgggattcaaatcattcaaatcatcaattactaaaaaaggaaagaacatgaacaagaccaatcatcatatctacaagactgaacaaatcgactgggagaaactggaatcggtaggtatcagcagatcgcaaattgaaaaggacggaaacatggacctgctccttcagggagaggaaaccaatgtcatgtccattaaaatcaagactcctgtattttcactgaccatggacgccacactcagtctgattgaagacgagaatggaaatccggtcatcagcgtaaacggtatcaacccttcaggtgaataaataagaaaccataatgtatcatctctctttccatacggacttaccgtatggaaagagataaaaacagaatttatcatgattgccatattaacagacaaaccaagtgtaggaaaagaaatcggaagaatcatcggtgcaaccaaagtaagaaacggatatgtggaaggaaacggctacatggttacatggactttcgggaacatgctgtcactggccatgccgaaggactacggaacccagaagctggaacggaatgactttcctttcatcccgtccgaattcgaactgatggtacggcatacacgcaccgagaacggatggataccggacattgatgccgtgctccagcttaaagtaatcgagagagtgtttcaggcatgcgataccatcattgcggctaccgatgccagccgtgacggggaaatgacattccgctatgtctatcaatacctgaactgtacactgccttgcttccgtctgtggatttcctctcttaccgacgagtctgtgcgtaaaggcatggaaaacctgaagccggacagttgctacgacagcctgttccttgctgccgacagccgcaacaaggcggactggattctcggaatcaacgccagctatgccatgtgcaaggcgacgggccttggcaacaattctctcggacgggtacagacaccggtactggctaccatcagcagacgctaccgtgaaagggagaaccatatttcatcggacagctggcccatctacatcagcctgcaaaaggacggcatccttttcaagatgcgccgcacacaggatcttcccgacaaagaatccgctacaatgtttttccaggactgcaagctggcacatcaggcacagattacaggtatcagccacagcgttaaggaaatacttccaccggacctgcttgacctgacacaacttcagaaggaagcgaacatccgctatggttttaccgcatcagaggtgtatgacatcgcccagtctctttatgaaaagaaactgatttcctatccgcggacttccagccgttatctgacggaggatgtgtttgactcgcttccaccaatcatggcgcgtctgctttcatgggagctgttccctgcagctaaaggaactggaggtattgacatatccaatttgtcccgccacgtaataagcgcagaaaaagccaatgtacatcatgccatcatcattacaggtatccgtcccggaaatctgtccgaaaaggaaatacaggtttacagacttgtagccggaaggatgcttgaaacattcatggctccatgccgcatagaaacgacaaatgttgaagcggtttgtgcggcacagcatttcaaggccgaacaaacaagaatcattgaagccggctggcatgatgtgtttatgcgttccgacatggttccaaaatcaggatattctgtcaatgaactccccgaagtggagaaaagtgatactctgaatgtatgcggatgcaacatggtacacaagaaacagctgccggtaaatccgttcacggatgcagaactggtggaatacatggaacagaacggactgggtacagtatcctcacgtaccaatatcatccgtacactggttaaccgtaagtatatccgttattcagggaaatatatcgttccgaccccgaaaggcatgttcacctacgaaaccatccgtggaaagaaaattgcggatacttcactcaccgcagactgggaaaaacagctggccggacttgaaagcggaatgataaccggacaggacttcctgaacaggatcaggactctcgccaaggaaatgactgatgacattttcaacacctattccacaaaagaagaataacatctatacctaatcaaccaagagaatgcaggccggaaggtctgcatttttttgtatccgtacagaaaagaatctgtttttccgcttttaagcggcaaaggtcttggattgcctgccttttgccgcaaggctgccctcatgggcttggctggacaggaaaaaatcatcctcgctgcgctccggtattttttcctgccaggccttgcgcaaaaaggcaatccaagaggccggaggcctataaaatcgggaaaacacatcccgatgggattattcattcataaaattaaggattatgaaactacagattatcagaaagatcggcagacatgcaacagcgatattcctgattaccggaatatgtctgctgacaagtaaagggattgtccctactgggatgattacgctgctgttgcttgcaggagggttcatcggttttctgttcaggatactggtcattattttcaagattcttattcttctgttcattgtaggattatttgtcgcataacccaaaatataaatatacatatatggaaacagttgctataacctcacaagctcctgtcatgccggctgtatggccacagaacgaacatatcagaccggttaaaagacgtctgcccaatacagttgatgaacctaaaaatatcggctactatctggaatcgctacgtgatatttccagcaatccggacagagagaatattctgaaagaattcttcaaggaaacttatgtataaccataaaatttttcaattatgttttttcaatcaatttatcagatgattacagcaggtacggatctgaatatcaatatccgtaaagtggacaacagcctgagcgtagcagtcatgccaaggcggaacagcctgaaagaggatacgcgacagaacatggtgccactgatcgtgaacggaacaccggcagaactggatatgggcttcctgcagaccatactccaaccgatacagaaggtacagggactgcttgtcaatgcggaaaatttcgagaaacaggcagaaaaggctacatcacaggccaaatcatccaaggctccaacaataccggccgaatcaaaggaagccagggaaaaacgggaaaagatggaaaagctcctcaagaaggctgatgaagcaaccgccgcaaaaaggtactccgaagcaatgacatggctgaaacaggcacgggtactggctcctacagaaaaacagaaggatattgacgaaaagatgcaggaagtacagaaacaggctagtgcaggaagcctgttcggtatggcagaggaaccggcgccggtaattccccaaccacaaggctatatgaacggtcagtcacaaccaggtatgcaaacaagcatattcccggagcaacagacccatactatgaatcctgaacctgtcatgcagcctgctccacagcaggtatcacaacaaattccacaaggaatacctcaaccggcatatggaacgaacgggacatataacccacctgctccaaacagcccgatagtaaaaggagcagacataccgcaaggcgcaacaatgcatccttacccacagcagccatactaccagcaagaggcgactccttatccaacacaacagccacagcaaccgacaaacggacatataccgaatggggctgcgcaagtacagaatggaaacggacgggaataccagactgcatcggctacacatgagacattctgcttcgatccggaagacgagaatgacagggaacttctaagagaggacccgtatgcggaatatccggattttccggctgagtaccgaatgaaggacgaggcacaggtagaaatggtatactgctgatatacacaataaacgatttgtaaaaccaataaactataaacaatatggcactggaaattaaaggaatgaaaagagtattcaagatgaagaagaacaatcaggaaatcgtactggatgatccgaacgtaaacatgtctccggctgaagtgatggacttctattccatgaattatccggaactgacaaccgcgaccgtacacggaccggaaatcgaagacgaccgggcggtatatgaattcaagaccactatcggagtaaaagggtaagagcatgaaaaaaggacaacgtaaagacaagaaaccatgtacacaacttacggaacgggctttggaaaatttagccagacttatcatatcggaactcgaaaatacggacataagccggggcatcaggaacagaaagaaaagaagactccctcccgcagaaagcctcatggttttctgaacacgagaataccttccatcgctcccgatctgtatgttgagaatgacagggatgtaacggtaaatgtcaccaccaaagagaatcttgatttcctgtaccgttcagccatgaagtatgcgcagctcctggatgtggagctgccataccatcctacaggcaggacttccacaagagagaaaatatgcctgctatataatgcactggattccatagtatctcatcatgtaaatctggaacttattggtgacaggctccagttctgcatctaccatttccatgaatggccggattatacgcttttctttatgccgatagactttacggaaaggctgcacggtgaaattaaaaagattacactggagttcatcagaaagttcatcaaatatcacaggatgatggatataaccgataccccttattttgagatgtcggaagtctgtatcgattatgtggactttgaacagctcgatgaggaagagaaaaaggatttgtacagaaaggaaaagcttttcaggtcatatgagaaagggagaatccacaggaagctgtgccggatgcactccagggctttctgtaggaatctggaagaacatatccgcaactgtactccttccagcgataaggaaagaagacttttggaactgattaccgaagggctgtccctgattgcaaaggacagcccttatatcttgaattatgattatgattttgcaagcgaaaaggaacgggatttcgagccgccaccgctcgaatatcagattctgcttacatattccatcacggatacggttaccaaagacatggaaagctgtttcagtactgactgtcaggaaacatataaccagactcccgtatcatttaccttcatcacgccggaaacagaggaacttttcaagccggacaactatccggaacggtttgagaaatggtttgagaaatttgtagaacatgttacctataatttataaacatcatgaatgaactgaccaaaaatatgcaaaaaatgatggtaccgaaggctgcaatcatagcctacaagtatgaagacagaagaaatcttgataccaggtactttatagaattacgtccaatcagaaaaagcggacagatgggggcaggtatccccgtcacatacgaattcatgaataccctgctggaatcctatacggaagaaatgagcgggataccggcaggcagagtccctgaaaacatgctggcctgcaatccgagaaaaggacaggaagaatatatctggtacaatccgcccggaaaaagacagatgttctttcacaaggatctcaatatacaggacggcatgttcaatctgccgggaattatctaccaagtaaaaaacggaaacatggacgtgttcgctttcaaggggaaacgtccggtggagacgactccgctgttccgtgccccgttcttcaacgtgaccggatcaagtgtctgccttggcaacagttctctggaaaagccacagaacccgactttcctttccctgctggaatactgggaaaaacggttctggctgactgaattctcccatctgggaggaaatgtcaatcctaccgtttcaaatcttgtcatcgtcaccgaaaatataagaaacaatccgttcgacatgaacgaactcaagcccatgaataaaaaacttaaagacatacttccatgaaaaagatacattttaccgaccgctacctgctcaatccacgtcatccggtaacggtattcgtcatcggagctggaggtaccggctcacaagtgataaccaatctggcacgcatgagcatggcacttcaggcattaggtcatccgggactgcatgtcaccgtattcgatcccgatacggttagccaggccaatataggacgccagcttttcagtgagacggaactgggactgaacaaggccgtatcacttgtcacacgcatcaaccgtttcttcggatacgcatggactgccgaaccgaaatgtttcccaacgaagaaattttcaggatatgatacagccaacatatttatcacctgcactgacaatatacgttcacgtcttgagatttggaaatttctaaagaaaactcgtaaagagaacttcaatgactatttggttcctatatattggatggattttgggaacagccagacaaagggacaggtcatcatcgggacggtacgtgagaaagttctccaaccttcttcacaagaatatattcccatgcctaaaatgaatgtcatcaccgaggaagtggactatgcgaaaatcaaggaaaaagaatcaggaccaagctgttctctggcggaagccctggaaaaacaggatttgttcattaactccacactggcacatatcggatgtgacatattatggagaatgttcaaggaaggaaagacactgtatcgcggtgcctatgtcaatctggatacattgaaaatgaccgcaatcccggtgtaatgacagaagtgaccgtatcatctttccatcagaatacggtcacttattctatttgctacttattatttactacgttcttaccacgctggagcaggaaactctgtatctctgaggcgagatagaatgatttcccgttcttttccaccgagtaatatttaatcttgccctcttgcctgtaacgtgccaaagttctttgtgacacaccaaggagttctgccagatccacattatcaagcagtctgtctccattcatacattctttcagacgattcatctggtccagtttcttttcaatgcgggcaaatccctctaccattgttcctataagtctttcgagtatctcattatctatatatgacataattccaatgttattaagtgaataaatcgatactctcttcgtgcgcactctaagagtatgtacttatagtagtgaaaatagtatgcctgaatctaagacaaagatcaacaagcttattaggcgctgataatcaggcgtataattttttctacttaatatttagtgtaaaccaaaagtgtaaactatgtaatacagaattgggaacgggttaacacagccaccaacaatgacatctgatgctacctgacgacacctaatgacaacattttgtatcatatacatattcaaaatacatttgtacaaactcaacttttttggatatggaaatcattggaattgaaacagctacatatgaaaagacattaaaggaaattgaaaacttccttgataccattgataaattgattacagcttcttcacagaaaacaataggggaatggttggataaccaagaagtttgcctgatcctcaaaatttctccaagaacattacagaatcttagagatacagaccaaatctcttattctcaaattgggaaaaagatttattataaaaaagaagatattcagaagttcattgaaaaacacaacagaaaattatgagcaaggtaattacccaagataatgagcaagttattcagatatacaataggttaaaagatacgctaacaagactcgaagatattctgaagaataacaacccaacacttaatgggcatagatatatgaatgatgcagaattggctaattaccttaaagtatcaagacgcactttacaagaatatagaaataatggaatcttatcttattatcagattggaggtaaaattctatatcgggaatctgatatagaagaacttcttgagaaaaacagacaggaagcattccgttaaacatttcttggaattttcgttgattttcaaagcaaaaatcagtatctttgcaatactgacaaagagttgtatatcagtgcagaacaaagaagttcaatcgaggtgaaataggtggactaaatgacaaacaacaagataagtaattgattattagcgataaaaaatataaggttccgcccccaggcggatcactgaaaacaaaagagaaat

SEQ ID NO: 68 - DNA, 52468 bp, Artificial Sequence
  Synthetic sequence
  misc_feature (12048)..(12049): n is a, c, g, or t
  misc_feature (12055)..(12056): n is a, c, g, or t
  misc_feature (34663)..(34663): n is a, c, g, or t
tgtcatggatacagatattccatttgaatttaaagcttccgatatatctcgcaaatttacctatgctaatattcagagtcatttatccaatgaaccgttgttgcatgacaacacgattcacagggtaggggagtggcgagattctttagaacgcgataatgaatatatgtcacattctgcacatccttttataccagatattgatattacaggcggtaaccggaaaaatagagaagatgatcttccgccattgaaacggaaaaagaaacataaaaataatgatttgtcactttaaaaatatctaatatgaacttccagtcacttttcaaagaatatactccagtagagtatggtgatttttttcgcctttatagaatcaacaataggggttatctcatttattgtaatgaaaataacgtaatttgctgtatggaattatacggttttacggatatttcggttattatgctggctgaattactgaaggttaatttagaagaattggaagattgcgaagagttttccctgcctgttcgttgcagcagacaacaaataatagattatttgtttgatgtttcggcaaaagaaacatatgtgaaactaaaacatgtatctggactgcatggctatttgctcaaatctatacatcaggataaatctggactgaatgcctatcgcaatctttttcaatttgatcccgttaagggaactacaagacttttgtttgacgataatcagtgcctggcttcaatacgcacagataagtctggctctgtatatatctgctgggatcctgtcttgttctttggtctggataaatccggtgatccagactcaacaggatatttgctttcttcatcttcaactttgctgattgattatgttttgtcaaaaatatcttgtgatagagatataatagtaatggctggtagcaattatttagaggctctgcttcttatttcttctctcgttacctcacaagatctttcttataaattatctgttagttatgatgatatgaatgtgaccattcagttcttgaactggcctactcctcaaaagattattaattttatctctcagcttaataagcatataccaaacggttatgaaaagctttcgtgtgttatggtaaataagaaaatatatttgcaggttccggctatccggtcttatttaaaaccgttgctttatttatattatgatttgttgtgtgatggctctttaaaattgtcattattgaaatctgatgcttcctaattattatctttgtgcctattttaatgtatttattatcaacctttataaatagctatatgacaaaatctgaattagttaaacaaatatcttattctactggtatagattacgcaacagcattaacagtagtagaggcattcatgtctgaagtaaaatcttcattggcaaatcaggaacctgtctttctaagaggcttcggcagctttatcctgaagcatagagcagagaaaaccgctcgcaatatttgcagaaacactacattaattgtgccggaacatgatatacctgctttcaaacctgccaaagagtttgttgcttcaataagtaaattgaaaaatatttaatatggacggttttatacaactatccatttatctgtatcacaactatctgtagatggtgtatgattaggataaaattacacaactaaattattttatgttatttttgaatttgtaacataatcaaaatatgaaagatcaacttgctttattaagaaaatgcatcgtaaatgatataccggctatcgtatttcagggcgatgacagctgcacagtagaagtattggaagcagccattgaaatctacagaaggcatggcgcttctcgcgaatttctgtatgacttccagaatgtgattgatgatgtcaaggcttatcagatacagaatccgcacagattgaaactggctgatatgactgaggttgagaaagaacttcttcgtaaggaaatgctggagaaaggtctactgggatgaacataaaacttaccatgtattctgctgacctgagcagtgaactgtcattgccgtttgcagatcaaggtgtgagagctggatttccttcaccggcccaggactacatgactgacagcatagacctgaaccgggaactcatacgtcatccggccacaacattctatgcccgtgcttccggagattcaatgaaggactgtggtattgatgatggcgacctgttggttatagacaaggccttggagcctcaggacggtgacatcgttgtggctttcatcgatggagagttcacgctgaagactgtgcgctttgacgataaggagaaatgtatctggctcgtaccggccaacgaggaatattcacccataaagattactgaagagaacaactacctgatatggggtgttcttacttataacataaagagacagcttagaaaaggaagatgatagcccttgtcgattgcaataacttctactgttcatgcgagcgcgtgttcaatccgctgctccgtgacaaacctgtcgttgttctgagtaacaatgacggctgtgtcgtggcccgaagcaacgaagttaaagcaatgggtatcaagatgggtacacctctctaccagattcgtgaagtccttgaggcaaacaatgtggctgtcttcagctcaaactacaacctgtacggtgacatgagtcgccgggtaatgatgctgctgtccgagttcacgcccgaactgacccagtactcaattgatgaagcgttcctggatctctccggcttcggagaaggggagaagttggtttcctacggtcacaggattgtgaagaccatcggaaagggtaccggcatcccggttacgatgggtattgctccgacaaagactctggcgaaggtggcaagccgttacggaaagaagtacaagggatatcagggtgtatgcatgattgattctgaggaaaagcgcatcaaggcgctgcagggcttcgaaattggcgatgtctggggtatcggccatcgaagcttggataagctgcactattacggtttaaataccgcctgggatttcactcagaaaagcgagagttttgtgcgaaaataacttacaattaccggtgtacgtacttggaaggagcttcgtggtgaatcctgcatcgatgtcgaggaactgccacagaagaagagtatctgtaccagccgaagtttccctgactccggtctgtccgaactctccagcttagaggaagctgtcgccaacttttcttccgaatgtgtccgtaagctccgtatgcagcacagctgctgcacagagataacagtattcgcctataccagccgtttccgtatggatcttccgcagtactgcatcaaccgcaccatccacctgcaggtaccgaccaacgaccttcaggaacttgtaagcactgcagttcgggcactccgcatggatttccgcaaagagggcggttatcagtacaaaaaagccggtgtcattgtctggaacatagttcctgattctgccatccaaaccaacctttttgacaccattgaccgtgacaagcaatcacgcctggccgccgccatagatgctatcaaccgaaagaatggccacaacaccataaaggtagctgtccagggcactacagataagtcatggcacctcaaatgcgaacacatcagcaagcagtacaccaccaacctcgatgatgtcattctcgtgaagtaaaatatggtgctgaatgtagcttatttatttcataattacagctataagtcaattttaatatctacatttgtatagtttgtataaaaacaatgatatccttgttgaatttttatttcgtaacgaaatcaaagttcttcaggagtataaggaaaaagcacatcgggaacttagccgggtacgtgatgaacagaaaacattcgggaaaataaaagtaaatacagaattatgaatcagttacacataacattagaagagaattcacctgctattaaatgggctaatacacaagctgacagaataggggcaagaggacatgtcggtactcacttggattgttatacaacagtaccagagaagcctgaatacaatatcacagcaatggttcttgattgtcagaatgaaatgcccaaagaggaagatattaaaagtcttaccacccttgaaaatatggctttactgttacatacagccaatttggagagaaacgaatacggaacggatatgtatttctccacagaaacctttctgagtgaggaagtccttcatactattttggagaagaaaccgctttttattatcatcgattctcatggtatagcggagaaaggaaagagacatatagaatttgacaagatttgtgaagctaatggctgccatgtaatagaaaatgttgatttatcatgcattggcaatcaaaaggaagttcagttgaaaatattaatcaatatcaatcaccaatcaacgggcaaaccctgtgaattgtattgtgtgtagtcctttcccctgcttataactttataaaagcctttggggagcctaatacccctgtatcaaaaatacagggggcaaggtatccctaacgcaagcatgtatatgtaaaatcacatacccattccaaaaccccggcttcttttcctgggctggtcgagttcttcttccagctgcttctttctctgcggtgcctggttgatatctggaacctggaatattatactatttccctattgttggttctcttcacgggctattatttctttttgtccaataatgtttggggtaatatatattttatttgcttttatcagatattcttcgtaattttataaattcaggcagaggttctggtaatagcctattacggaagacgtgcatggctatgggcggttagggtaacttaaccgctttttcttttcaaattttctttgttaatagaaaatttctgtatctttgctttgtcataagacataaataacttcttacactgtcattctcattcatttcttcaattcttgacagtagtaaatcaaagcacattataatttaagtttatagctgcatctgcagcctatctatcgcaccctctccaggctgtgatagatgtttcctcatttattcacttttcattaatcatttaatcaatttcattatggaacaggtattaattggccagaatgccggcattatctggcatctgctcgaaggtaaaaatggtgtagaagtatctctttttaagagggagtccaagctctcagaatctgagttctgggctgctatcggatggttgtctaaggaagacaaactttccttctctacagaaaaagtaggtaagaagacagtgaagacatactctctgaaagactgattcattgtgcgctcatgctgtaggcttgcttgattcctgatggaataggcaagtctttttttttacaataaattttataacacaatacgttcaaattatttaattttgattttgtgacataatcaaaatttactatttttgtcccaaaccacacaaattagcttatatggaaaataaatttgaactagttgaaaaatataatattgatgtggatgtctttattgaagaaaacggtgtaactcctgttggaaaactccctgacaaccatcttaccaaagagttttttcgcctatattttactggacagattacaaaggtctggaagagatggctttctgaatgttggatgcaaactccttaatctacagacctatattagacgggaaccgctatattacagaacaagaattatcaaaagctctcaaaataacaaaaagaacactcattgaatatagaatgaatggtaaattgccctattacagaataggaggaaagattctgtataaggaacaggatattatagaaatattggaaagaaacaaagtattggcatttgaataatatctcttaaaacattaataatcaaaagataaactttataaaatagcttgtagctacccctaaataattatataaatatttggaggaatagaaccgaacacttacctttgtaaagtcaaaggatgattaacgagaatctatcgaaaattggtgaatttggcatatggctgattcagtggttcggggatttttccaaagatattaaagtgctgtaatttaggactttgaatagtattattcgattcctggtggtaaacagtacgctgaactctacatcaaaaggacaagaggattttgtagatttgaaaactatatcaactacttcatattttttaatttcaatatactttgaactctttactctatttaaggaggcaaaagcatgtattgatatagtaacagagattatcaggataaagtaaaatttcagtttcatagacctgtgttcttcataaaaaaatcccgtataggtcctatagaaccatatacggaatatataacccccaaaaaatcatcaattcatattttgtaaatatctattgtcgactattctttcaagctcttttttaagtttagcagccacctcaggattcttgtcaatcacattcactgattcactcctgtcgccattcaacttaaataactgatcctttggactattccccaactctgtattagtctgtacattcaaagcaggagcattatttctaggaataaacttccattcgccatctgttatgccaaggaagttctgaatattctgtgttacaaaatattctttacccttttccgatttacccaaccatgcatcaagaagattctcactgtcaggcgctgcaccatcaggtaaagttacaccagtcattgcagcaaatgaagcaaaccagtccaattgagacataagcaaatcgttaacacctggtttaacgtgatttttccatctcaagatacatggaatacgtgtgccagcctcatagttactgtacttgccacctctcaagtcgcctgcaggcttatggtcgccaagtaattccacagcctgatccttataaccatcatctatcaccggaccgttatcacttgaaaggacgacaattgtattttcgtcaatacctaatctttccagagtcttcataacttcgcctacaccccagtcaaaagacaacaaagcatcaccgcggagaccgtgtccgctttttccgacaaatctttcatgcggatcacgaggtacatgaatatcatttgtagccagatacaggaaccaaggtttatccgaagccgacttttcttcaataaatcttacggcattggcaatgatactgtcctgaatatcctgatctctccataatgcagatttacctcctctcatatatccaatacgtgaaataccgtttacgatactcatatcatgtccgtgagaaggatgaagtcttagcaactctggattgtcttttccggtaggctcgccagggaaattcttggtataactaacctctacgggatcatctggtgataatcctaaagctcttccgttttcaatccaaatacaaggaacacggtcagctgtcgcagccattatatgcgagaattcaaacccgatatcgcttggatttggagaaaccaatccattccagtcctgctgaccagccttatcaccaagaccaagatgccacttaccgatgacacctgtcgaatatcctgcatcaacaaacatatcagccatagtatatatgtttggcttgataatcatagctgcatcacctgccgctatcccggtacctttctttctccacggatactcaccagtgagcattccatatcttgatggtgtacttgtagatgcaccacagtgggcatttgtaaacattataccctcagatgccagtttctccacatttggagtaataatcgattttccgccataacagctcaaatcaccgtaaccgatatcgtcggcataaataaacaatacattaggtttcttattcacttctgcagcgtcttttttccctccgcatgaagacagcactgctgcggcaattgccggataaaaaaataaatcagttctcatatgttttttctatataggtttataaattcgtttcatcatcattaactgtaacctccaaaaatataactcttctgttttctgtaacagttctatctccaacgtaatacatttacctttaagtccttcatacatgcaaactgcgaaatatgcccgatgccataaggtatcagcttacggcacttttctaagcttaacttaccattctcaacaattaatataggtcttataccatgaatttgcgcagtaggttcatcaggagataataaattatagacagaatcaacaatggtacgaatgctatcatctacaaaacaagtcctattttcgaaaggaatattaatatcttcatcttcagacgatttctccgaacacgaaaaaataaattggtagaaaaaataaaagtttattcataattagttttaagtttttatatgaacacaaaaatataattaacctaccagactagtcgtagatatttctttcgaaattagggggtatttttattttattctatccctttttaagataatctccttctgctttttagtcaatccccttcgatataactcttccaaagaaaaaggaacatcattctttttcatttccggatcattgaaatcaatactcaaatcacagtcgaaccgcaataaaatacttcttctgtttcgaccccacaaattataatgggaaataccccatgttatgccattagcaaacggtacatccgtaaaggcatccgggtcataaagtcctgaagcaattggcatcatggcacaaatacttgcaaccttgaaattcttgccatcctctgaatattgaatagtattattttcatgcccgtctttagccataatcgaggctatcccctgcttgaaacggaaaaactgagtctcatgtccggaactgataatcgggttmaattcatwttttttgaatggtcccataggattatcagytakggmaagmccckgagrgsgratwaaaccgccattatcctttccgttataatccgatttataatatagatatattttccctttataaaccaatggttgagggtcatgaatagaaaattgatcccaatcaccgggttcaccgtttggaataatgatttcatttacgggagtccatggtccgtcaggcgaatcggcatacgacattgcaactgggcagtcatcacgaccggtacttccgctcattacagaaaaggcctgataatataaataatacttgcctttccagaccaatacatccggagttgcaaccgacctccacccaagttccggtttcttcgggcgatgtacagctatcccctgttcttcccaatgaaaaccatctttacttgtggcatatgcaatatcacacaagtcccaatccacagacggaatagtatcattagcaagctttgtccctacaaaggttgttggagtgcaacgcttggtgtaccacatatagtatttaccgtttaccttaataattcttgaagggtctcttcgtgttactgtcccatcatcattatgatagtcaaagcctgtaagcggtgagtacttgaagttcgtgtataattcattcaactgtggagttgcagctccgtaattatcatacactctgttcatagcgcaactcatcttgaaagttggcttttctttaggcataacataagggaatggattctgtgcaaacaagtctgcagaaactcctatcaatactgatactaaaagctttactctcatactataaaaatattaataaaaaaatcaattacgaatatattgataaattaccaaacctaacataggtaaatttaaagtagatagtatgtattttaaaattaaagatttttttctctttatcttagactagaagtattcagtctacatacatagtattgatactatcatcaagaagatcattcttttcacacaatccgccggtccaggtctcatcagcagtccacaaatcccatatgatattcagttctagagtaaaatcctgttttgataccacatttcctgtaggttcaccattcaagtaaaattgaatattgttggcatctttccaccacactccaattctttggaacttttcattccatttcactccttttgccggatttccgtcagagagtttcctgttatcgaagttaccgttatttctttctgtaacaccattcttgacaacaaagtattgcgaatacatagtataaggacgtgtattctcctgtgccttaatagaaggttttgagttatgctcacacatgtctatctcatccctgtcattactgttgccattattcatccagaaagtactgaaagccgaaatatgtgcggtacgcatataacattctgtgtacatcggatatgaaattctcgtattcgacataaccctagaagtcttaaaccacctttccttgccatcgtcaagtgtagccttgatccaaagcaaaccgttatctactcccgagttctcggcaaccatctgtaccggtacgtcataattccataatgacctgtgccattttgtagcatcccagtaatcaaactcatccgaaaggctttccaccttttcccatttaaaaccttccggaacctccggaaggttttgcgcattacaaacaaaatttgctgaaaacatcagcgacaaaaatgatagtaaggtcttcatcatatmcctctaatattatttraaaaattaaaaatctgcatagtaactgtacttacgtgaccgccattatctgggaactttaacgagatagtattatttcccttaagaatgctgtagtccacaggcacttcaataacaccgaagaaagaagcacggtctttctgaacgtcacccctgaaattatccgggatatcaactttcttaccgtttactaaaagttcaggcagcaacgacaaaccatgatttctgccaagtccaagacggataacggcctcaccatattcggtcttcttgacattatttatattgaaaaccagttctttgccagcagcaatctctttaaggtaatccgttgcataatatttcacctcctccatcgtttcgtttattttcacttttctgtcgaaattatagcaaatgacgcatgttgcctcagtttctaaagtaaagtggtcaagactctttgcatcgtatacatcaagcataggtactccgtctttcccacctttaaggtacagatgtctgacttctatactttttgcatccttagatgttccgtttacagaaagattcaaatctactggtttgaaatccagattgtttataatgaaatacacattcttcccgtctacatatgcatcacacataatgtcaggattatcacagtttgtttcaacccttgtacccttcacatccttccagagctgataaaactttataagttcagagtaaacatattctccggtaaagctttcaggctcgttttctcttctcagcattctcgctgtatgtgcaagacccgttttgggattatatccccactcagatttgagcatggcaaaaggcatggcataacatatattatcggtcctttccataaactgcataagcatcgagttggtcgatttcagtcgcagccagtcgcgatatggcgaccatggcttcctgttgtaatcatgcgtctgcgcactgtattccgaaatcataagaggtttaacctcaccaagctttatcatactgtactgctcaatcatatccattgtggcctccatgttactgccttttctgtacatctgtttaccatctttacatggaaaatcgtataaatgaatagtaaagaaatccatatcctttccggcaatatcaataaactgtttccatctggcattccatcttccgaaattctggagttcaaaatcagggaaggcagtgcaataacctcccactttcatatcaggattaaactttttcacctgtgcggcaatagtagagtggaattcaaataatttggttatacttgactttggagctttcggcttatcataaatatcccacaaaggctcattaattmccycacagamcccaggcttaggttcmccnnctttcnnccycctycacmaaaatmctccttaatatmcctgccataaaattcacccgaagctgttccgaaaggctcatcttcagtatccttctgcgataaagcccatcctttcagcgttttagttccgtcaggataaaaaggagagaactgattacaaagaatcagattactgtatttctcgtaaggatgtacctttgtgttctgaacataccgtttcttattctggctacatagtctagccaaatcatctgggtcggcaaaacctggtctttcgggatcctccttaacattgcgaagcacagtcttgatcatacctgtttcacgccccacatacacatcatattttcttataaggtcatcacgtaaatcagcaatcttatttgcactatcccaataattctcatttattgtagcatggaaatttataaacttaggacggttaaactctgttacatccccaagcttatgttttacattcaaattcaattgcacatgagtctgtgcagaagcggytaaatgaacagccataaaacaaaacaagccgataattctgtttttcataaattattttatattaaagtacaatattagtaaagtttatggttttgagaataaaaaaatgctccgttattgaatatcatctaacggaacattttatttgaagcaaagaacttttatcttgatggttcaatcaatatgtctttttccattatactgatattatcatactttttaaccagaataccattttcatcatattcagaatttttcagtcggatattgtatggcaaatatatatcatacaaatagtatttatatatggcaaaatgcaacttttccctaagtaaatgaaaatctctcccataaagatattttttctccactataactagaataaatcaaatccttaactatataaaaagagaagagaccatctcaaaatcattttgagatggtctccataaaataattatttatcctctaccggtttataaattcttatccagtcaacaaggaatgtattattatctttattcattaattctttgtttgtcggagacaatccacttatagctctccagctctggtcttccatgtttataattatatccatttctttcgatagtccggtacccttagtaaaatcattggggtcaataatatttttcccagatacccttcttaccattttaccatcaacataatattccaaattaaatggatctttccagtaaactcctactctatggaaatcatttctccaaatagttccattcacatctttataccaacttccaggatctgttggttgatagtcctgaaacggatctctaataaacacatgatgacttaaatgaattctatcaggtccgtaaaatttatgtccatcatcacctacaaccctatcgctaccatatgcctctataatatcaatttcttgagtatcatcaggacttaacatccatacatccgaagccattgttgagttagctatcttggcatatgcctctacatacacaggatatactactctagttttagatgtaacacaccctgtataagtgccaggcatcattttttctttatctccgcttgtaaccttaactatttttacatcgtcaggtctactggtttcaattcgcaaacaaccatctgagacagaaatatgatctctctgccatattgtaggagctggtcctgaccagttggcatggtaataatcggtccatttcttttcaaaattacctttgttattactgtcagcagtatagttaaagtcatccgactgactctgtaattcccatttcattccagtacctgccgaaactggtacaggaaacttgtcccattcatattcaaattctgtttcagaatcacccgggtctgtatttgatccgttttctgacccattctcttctccattattatctcctggcatacaggaactacaagaaataaataaaaatcctaatgataaaagcaataatttcaattccattctacaaaaaatttaattaataatatctaagaaatagatagggagctaaccctatctatttttaatttactatggacgtttttctattttagtcaatgaaatatcatcaaaatagaaattcaatgctgatgatgatttttcatttgtagctctaatgataattcctgaatctccagctttggaagatgacattttacatgtaacattcacccattgacctttaacaaaatcattattaaaccatacaccagtactccattttgtatctattgcaaaatcaaaagtaatatttggatatattccatttactggagtaccatctaattcttgtacatttatccacatagaaagcaaataatcaacatttgcttctacagggatggcataatctcctgctactttggtatcgcaacccattatcattcctttaccagcagaaatttctgcatatgcaacaccgttaccagaatgagcattatcatttaccatagataatttatagtcgtcccatagagttgctccccaagaaactttatcccaatcttctacagtacaattttcaaaacctacatcatatcctgcttctttcaaaagatttgacatcttgaaatcgaaactttccggttctgaaataaaatttgtagcataaacatagtcaagtgttatcaaattaccaacagatgcatcgtatgaaacagttatattatcggtattataaatatcagtatctaatacaagttttacaatattgacatccgtacttactgattgaatatttgcaactacaggaatcatattttccccgttggttatattcagtgaaaaagcattaacaggacagtctgatgcatctttcattgcacggctaaatttcaaacctatagtattggatgataatctttcagcaccaataaaatcaacaggatcttccgaagctataacatttaccaactctgtatattttatgctgctacgtccaaaatcacttgatgactccaaggtaacctcatacaaccccggtgagtagaactgataagatgcaataccgtcaactgcctcaactgtttctgcctttccatcttcactaacaaaagtgaagacatttttattaggtgcacctgtagaagtaacagtaaaatctatgtgatgaccaccttgcagctcattcttggcgcccgaagctaaatttatttcagcaccagtttctctacacaaagcggtaaatgacgctctaacactatctaaaaccgtaacttcaacaaactgttccttttcattagtaagtccatcctctgtttctatttccttacagaatatttgtttaagagaaatcttatgaactccaggaacaataaaactaactttcaggttttcggatgctgaggttgtaacttccgtagaatctaaattaatggctacaccttcagggaaagtccatgttctggattcaacacctcttgacaaatccagaaatgacatccaaccattaacttgcatcaaattcgctttatttccaaaagaagtagtaacatactcctggactatatcttcgttaaactcatagtccttttggcaacttattcctaaaaaggctaaaataactaataatattttatttattgtcttcatcgtattaaaatttaattctgtaatgctttattattctgaacttcacagctaggtattgggaaataatcgtgaacatccgactgatatacctttgaacgcatctcaaaatcaggacgcacacgttccttaacatttaatggtggaatctgttctgtagaacttattgttgtacttgtaatagacccacataaattcaaacgtataccttgttcttcactccaacattgttcgaagcactctttaaccaatccccaacgaaccaagtcaagccagcgatgaccttcaaaagccaattcaagcaaacgctcagccattcttaaatgcatcaatacattatccttattggcaggaatcatctcaaagtctgtgtaattatttgcaaatttagagacccacaatttagggaaaaatccattattctctgttatataatccttaagttttactacccctgcacgttctcttactttatcaatatattctattgccaaatctacatcaccatcatcttcaagaatagcttcggcatacattaacaaaacgtcagcatatctaatagctctgtaatttatacctgttctacatcctgtagtaggatcctcagattccactctatcccaacgtgtccatttccttactttagaactctgaccatatccaaagtttacttttcctttggcaacaagatttccatcagcatcatattcatcaacaagaggagccttataataatcaccgtcacctttctcaactacaattgttgcgtatgttctcatagagttcaaatgtccagcttttgtccattcagcatcaggatccataacatctgccgaaacaaacatttcgtggcaatggtaggtaggtaacactgtattgtaaccacctgcaaaaagagaagcaaactggtttgcaatagatacaccttccgaaccatctatctcgtcatgcaggtttccactatttcctggcttgtagttatcggagaaagagacttcaaatacagattccttattaaactcattatcagtggtaaagttatccatataattttcttccagttcatataagttgctttcaactaattgcttaaagcattctcttgccaacttccattctttctggaaaagataagtcttacccaacatagctgtagccgcaccccaagtgatatgtccgtcattaccgttgggccatactttaggtaatatttgagcagcctgaaaatccggaataaccattttatttattacatcatcctttgatgaaaaaggaatgttcatttcttctgccgaagaagccattttatcatgtattacggctccaccataagtattggcaaggaaaaaatagtcatatcctctaataaaacgtgcctgagctattatctgttctttcttctcttgtgtaaggaaatctgcattttcaatgtaatgtaatatttgatttgctctgaaaatacctacgtacaattgtgaccaacggttttcaacatatggtgaagagctatcccactttaactgggtgaagatattttgagtactataccatgtttctgtacctgccaaatcacttcttagcatttcgaaagtcaatcctgaaccacttacatattccaactgcaaagaaccatacaatgcatttacagccttatcaaagtcagcttcggttttccaaaacgagccatcagtcagagaattgggattaacttgtgacagcaaggcatcttcacaactcgtaaaagttcccccaataagagagaaacataatatataagctaatttctttatcatagttttaaaaatttcagttaatcaaattaaaaatcaagctgtacaccaaataagaattttcttgttataggatagttggctttatcaacacctcggcttgcaacaccatctccaccaacttcaggatcatatccctcatatttagtaaatgtaaacggattttgtgcagttacatatattcttgcataatccaaaatacctttaaaccactttctaggtaaagaatagcccaatgttatattgcgtaatcttaagaatgttccatcttccagaaagtaatctaatctaggattacaattatatggttcaggtacaggtatatctgagttgatattgtttggagtccacatatcatataattcaacgtgtcttactcctgcgtatgcaaactgttttgcaccgttgtataccatatttttatgtgaataatatagctgagtagaaaaatcaaaacctttataatcagcattaaaagttaaacccatttcaaatttaggcatactgcttcccttataaacacgatccttatcatcaattatattatcaccattctggtttaccagtttcaagtctcccaattttgcatttggcatataagacttaacagcatccagttcttcctgagtctgtattactccatctgattcaattaagaaaaatgaaccagcaggataaccaactttcatatatgttgtaacattatcattattcaaccaggaaccaagtttactattagccaaaggtatttcattcatatcacccaacgaagtaatttcattgatatttttagtgaatgtccctatcaatgaccagttcatgccaaattttgtatgtcctttgtatgtagccgagaactcaaaacccttatttaccatgtttccgatattagaagtaattgagttatttccccaacctacatttgtaccagatgatgcaggaataatcacatcaagcaacatatccttcttattattcttatacatatcaaaactcaagcttaaagctcctcttaataacgaagcatcaagaccgatattctttgatacatttgtttcccatactatgttaggattggaatacgctctctgtatagcacccagacctaactgatcgcctgtttccggtccccaaacataatcaatctggttgcggatgtaagatgcatatttatagtcaccaataccttcattaccaacctcaccataactggctctcaatttaagattgctcaaccaatctacatttttcaagaacttttcttcattaatattccaacccaatgaaacaccagggaagaaagcatatctgttattcttagccattcttgaagaaccgtcgtaacgtccactggcagataacatataacgaccgtcataagcatattgtaaacggaacaactttcctacaattacatgagtagatttagatcctccaattgatgtaagaacatttcctgcatcgaaaacaggtgtatcattactaatgaaatcttttttagacattgcgctctgcacccagtctgtcttttcaatagtataaccgattacagcacctactttgtgctttccgaatgttttatcataacttaatacattttccatagtaagtttcatgcttgaattatcctcctgcaaaagacttgcatcaactctacttgaagctgtgttaaggttcccgtttttatcataaaccataaactgaggttcaaagaaatctcttttatattgccaatagttataacctaaattcacctgataagtaagaccgtcaataatctctatcttaaagtttgctgctatattatgagaattttcaactctgtcatcagaattagtcaatatacgagccaaatatcccaaatgttctacgttgttatcagcatcaatttctacttcacttccatcttccatattcaatggtttcatatatggtttctgatattgtgcaaactgatatacattccaaggctcaacagatttatcagaatgatttaagccaatacttacaaatccactgaaacgacctttcttaaatgttgcatttgcacgggtagagaatctttcgtaaccggaattaataagaataccatcctgtttgaaatagttggcattaacattataagtcataacatcactaccgccacttacagtcaagttataattttgcattggggcattatctaaagttactgatccaataaaatcggtattataatccattgcatcgggattataatataagtcggaagagttaccacctaaagcacgctgatacatttcatcaacatacaactgctgtggtgtactaagcaatggagttcctgatacaatgttctgtagaccataataaccagagaaacttacttttgctttacctgctttaccgcgttttgtcgtaatcaatataacaccatttgaagcacgtgttccgtatactgcagccgaagcaccatccttcaacacatctattgtttcaatttcttccgcaggtaaattaggattaccgtcagccggtattccatctacgacataaagaggacttgaattaccattaatagaacccaatccacgaatttgaataacagcgccatctccaggacgaccggaactttcagtaatattcaaacctgaaatcttaccttgcaaagtttttgtaaaatccgaacctgctatttttagcatttcatcagactttatctgcgaaacagcacctgttaattcttttttcttctgtacaccatagccaatagctacaacctcagcaagcataacagattcttcttttaaagaaacattaatttgtgtttttccattaacagagatttcttgtgtttcatagcctatgaaactgaatacgagagtcgacttactatcagcctccaaaaaataattaccatcaaggtcagtaattgtccctgcggtattatcacctttaacagaaactgtagcacctattataggatctttcatttcgtctgtaacttttccactaatagtaatcttttgtgcactaattgcagatacacaaaacagaagcattaccaataaaggtaacctctcccactttttgtttttgatttccataaattgattttttagcaaacaataaattaatttttttgcaaagaaagtgatagttggtgttttatatatattggaaaagagtttttaatatggtgtatttgcatacaatggcattttttttataaaagttctcatctacaatataagcaattatagacatttaattttacaagtgcaaatatacagctgatggtagatcagattgagtttcaccctggatatacacaagtggatacagtactttattgccagagaaataatattacagtaaagcatggagtccgcttggaaacggatatatgctgcagtatcctgttctatgtgaaatagcatcaagatacaataaatcggtggctcagctatgtttgagatgggtactacagaacaacgttgttccactgccaaaatctctgaacaaagaaagaataattcagaatgccgatgtatttaatttcgaacttacatctgaagatatgaatttaataacgaatatggaaacatgcgggttctccggctactacatagacgaaaatatggaataatacgtttaaacataaacttcccctaaaaaattaaaagtattttataggagaagtactcaaataccatacttttttttcaaaaaaccactgattagttttttttaatggtaatacctttgccaataaagaaaaggattgtttgagcaagtggtatacataattaaggtagattgttttcaagagataacaaacagaattatttaatggttgttgcattgcagcaaccatttattatttaattattaacaaatggcgttttatgaaaacatctgaaattctaaaagcaactctcttacttgttccggcaattgcatgggcagaaggaaacaacgaacaaaaaaaaacaaacattgtgtttattctctcagatgatgccggatatgctgatttcggttttcagggaagcaaacagtttgaaactcccaatcttgacaagctggcggaaaacggaatgatactccaccagatgtataccaccgatgcggtgagcggaccatcaagggcaggacttatgaccggacgctaccagcagagattcggtatcgaagagaacaatgtagtgggatacatgagcaagcacggtaaatacggacttgacatgggtgttcctacttcagaaaagtttatatcaaactatcttagcgaagctggttatgtttgtggagcattcggaaaatggcatctgggagctacagacgaatatcatccttacagaagaggttttgaccaatttgtgggattccgttcgggaggtagaaattattatccttatcagaatgaagaagagtcctttgccgatgagggtgtggaaaacagacttgaatacggattcgctcatttcaaggaaccggataagtatatgacttacctgctcgccgacgaagcctgcaagttcattgaggaaaatgcaaaaaaaactttctttgtttatctggcattcaacgctgtacatgctccgctacaggctgaaaaggaagacctggcgaaatttgctcacctgaaaggtaaaagaaaaagtcttgctgccatggcatgggcaatggacaaggcttgcggacaggtgttcgacaagcttaaagaactgggacttgacaaaaatacaatcatagtgtttactaacgataacggtggacctaacggaactgaaacttccaactatcctctgagcggtatgaaagctaccttccttgagggtggtgtaagagttcctgccataatttcttatcctggtgtgataaagaaaggtagccactacaacaagcctacaagcttcctcgatttcttgcctgctttcatcaatcttgcaggttacgacaaggaaattgcaaatccgctggatggtgtagacattattccctatcttactggcaaaaataacggtcgtcctcaccagactctttactggaaaattgaaaacagaggcgttgtgagagacggcgactggaagttcatgcgtttccctgacagaccagcagaactatacgatataagtaaggatgaaggcgaacagaataatctggccgacaaacatcctgacttgataagaaaatattataagatgttgtcagactgggaaatgacactagacagacctatgtggatgctggaaagaaaatacgaaaagcgcgtgcttgaacagttctatgagcaggaagaatacagacgtcctaaagaatataaataatagacaaataagttataagactgagcgaaggaacggattcttaatgtcaaggctaaacaaacaagtaactttagccttgacacttactttattaaaacaaaagagataagtaagtgatctaaaatatttttatattcaacataaaatattacatttattgtatcatgatattttagaatgtaaatcatgaaacatataaaagtgcttgaattaagtgaggctaatcgcctcgaattggagaaaggctatcataatggccctactcataactatcgtatcagatgcaaatccatattgttgaagtcatcaggaaaatcagcttcagaaatagctgaaatattcgatgtgacaataccaacagtatacgcttggataaaacgttataaagaaaatggtatcaaaggcttaaaaacacgtcccggccaaggtcgtaaacctataatggattgttccgatgaggaagcagtccgtaaggctatagaggaagaccgtcagagtgtgtcaaaagcacgcgaagcctgggaaaaggcttccggtaaaaaagccagcgacattaccttcaaacgttttttaggagcattggtgcaagatataagcgaataagaaaacgcccaaggggtaccccctcaccgcaactctattcatacaagaaagagaagttgcaagaacttgaaagccttgattccaaaggttaaatagaactttaacctgttggcggaattaaaatagcgcatatttaactctgccaataggcttttcatttttgtagttaatatattgaaggattgtaagtgcgctaatcttcccaataatccgggcaaacaatccatctgtatctttcgcataattccttataatcataaactggtcacacaattgcgagaatagggtttcaattctttttctcgctttggcaaaagccggaaatgttggcttccattctttttgattacatctgtatggtacctccaatctgatattggcagtttcaaacaaatccaattgcgcttgggcacttatatatcctctgtcccctatgactgtacaattactataatccactttcacatccttcaggtaatgaatgtcatgcacacttgccttagtgaggtcaaaggaatggatgataccacttaacccgcagactgcatggagtttatacccataataatacatgctttatgatgcgcagtatcctaccccaggtgcttttctaaaatccttctttcccatactgcaacgtttggaacgggcaatacgacatacttctatcggtttcgaatcaatacagaaatagtcttcaccaccatccattttagaaaccattcttctcggattgcattacatagggaggaagttattttacgcctgtcattgtattgtcggcgggaaataaggttgggtatttcaaccctatattcctgtagctttgcaaacaacagcgactcactgtcaataccaacagcctctgatgccatgttcaaggccactacttcaaggtctgagaatttagggacgactcctcgtcttggtacattcccggattcattgactaaattgccggcaatttgcttgcatatgttcagtaattttgcgaatattgcatataagttgtgcatacgatatttgtctattaaaagtttagtcacctttaatttactaaatatcaacaatatgcacaactttttaaacataaatcttttataatttaattccgccaacaggtaactttattatgctgatgaaagtcatgtatgtaccgatggttatgtaccttacggatggcagttcaaagatgagaatgtatatattccatccgagaaagctgcaagacttaatatctttggaatgattaccagaagaaatcaatataaaggctttacaacacaagaatccatcaatgcagacaggcttgtggattatcttgacaggttctcttttgaggtaaagaagaaaacggtggttgtacttgataatgcttctgtccataggaaccgaaagataaaggaaataagaaagatatgggaggatagaggattattccttttctatcttccaccatactctccggaacttaatccagccgagacactatggcgtatattgaaaggcaaatggataagacctgctgattacaatactaaggactcgcttttctattgtacaaacagagctcttgcatctgtagggacgaacttatttgtgaattactcatatgtataaaattaattttgaatagttacttatgaaaaaattttgtttattcttttgcataatatttacttgtataattaaggttttcccgcaatatgtaataaatggcgaagagtatgaattccgtaccaggaatttgcctcaaagtgaagtcaatgatataattcaggataagtatggttttatctggatagcaacacttgatggtctgtacagatatgacggttatgaatataaggcatatttgagtgacgggcaggaaggggctataagtacaaatatgattctgagtctggatattgacagctataataatctgtgggttggtacttatggacgcggattgtcacgttttgactacgaaacaggtgaatttataaattttcccattgagatacttataaacagaaaagatttaaaggggggggacattacagcggtaatggttgactcgcagaatgatatatggataggaatgaattatggtttgttaaagattaaattcgaccataaggaaaatattataacagaaagacatttttttgagttcgagggaaatgcttccagtgacgcaataaaggatatatatcaggatgtatatggtaatatttggattgctaggaatgcatatactgaactggtgacaggtataaaggatgataagctggtttcaaataaaattcacatctcaggcaatatcataactggtgataagagtgctattcttgtaggtggatctaaactgtttaaaatagaacctcatgacggtacttttgataacattactcctgtcctgctatacgataaacctgtatctgcactaataaaagattttgataatatttgggtggcaaatagaaggggtttggaatatctttcccaatcagaggataatgaaaattattcaactcaattcagtcttaataaggagtttgtcaaatctttgaatagcaataatgtgtcatgcttgatgactgactctgaaaacaatatatggattggaatcagaggtggaggactatactcactaaacaagaaagcacataagtttcagaattatatacccaaaggttttcataaagatccttccggtagaaaacagaagagtgaatgtatgcaggtccgtgcggtttttgaggactccgacggtaatttgtggttaggtgaagaagaagaaggggtgttcaggctctctgcagataaaaattataatgatttgtttcaagttgtaaatgtcaattcaaaatatgagaatagaggttatgcttttgaagaaacaaaactcaaaaatggtcgtaaactgatatgggtaggaacaagttttccggcaaatcttgttgcaatagataacaaaactgccgatattgtaaattactcttgtccttcatcacttaaaatgggcttcgtgttctcaatagaaaaaacttcggaaaatgttttgtggattgccacttacagtaatggagttttcagattacagcttgataacaatggaaatgttgtggattacagacatttcactatatataattctgatttatcttcgaatataatccgttctttgtattttgataataaatctaaaatatggataggtactgacagtggattgaattttattgatatcaatgatgaaaatctgaaagtaaaccgtataacattcagtggggatagtgactggttcaatcatctttatgttcttgatataaaggaatataatggaaaactgctgatgggctcaatgggtaatggattaatattatacgactatattaataacagttgcacaaaactgactacaaagaacgggctgcacaataattccattaaaactgtgctgacagatcaggataataatgtatgggtatcgagcaacaaaggtatttccagagtcaatctaacagataacagcattatccattatggaaaagataatggcatatccgaagaagaattcagtgaaatatgtggtgttaaacgtcataacggtgaacttgtatttggaagcagaaggggaattcttgtgttcaggggtaatgaaatagtgaaaaatgagagaaagccaaaagtctttataacagacatgctgactaatggtacatcattaaaatttaattccgagcacagtgagctggtactggattattatgacaggaatgtagcgttcagatttaccggactacagttgtccaatccaggaggattaaagtattactataagcttgaaggttttgacaacgaatggcagctaactaacagtactcagagaactgcaagatacaccaacttgcctgagggcgattatatatttattgtaaaagccagtaatgaagatggttttgttagcgaacatccagcccaattgagtttcaccgtaaagccaccatttgtacgtagcggactggcatactttatttatttcttactgtttgtcgtccttatgtatatatcttatttgatattaaaagctttctatagaaagaaaaaagaagtacttgcagcaaatcttgaggctaagcaggctgaagaaattacacaatacaagcttcagttctttacggacgtgtcgcatgagttcaggacacctctcactctcattgagatacctttggagtcggcaatcaataattgtggatctgacaagaaacaactttattatttgaccctcatacgccaaaatgtttccacattgaaaattcttataaatcagttgttggatttcagaaaaatagaacgtgggaagctacagtttaatccgtatccggttaatgtgtcagatgtggttggagatatttattcgaggtttaagtgtctctcagagagcaggaatataatatattctataaatactcctgaagaagctgcagtttcgatgatagatatttctttatttgagaaagtaattgtaaatgtaatttcaaatgcattcaaatataccccacaaggaggaagtataagtgtatatgtagcgaatgatgccaataccataacagtgtctgtacaggacacaggtgaaggtatttctgaggaagaactgtcgcatctgtttgagagattctatcaaggcaaggagcataataaactcaagcaggctggtacgggtatcggtctgtctatgtgtaagaatattattgatgttcatggaggaaatatcgaaattttcagtaaatcgggtgaaggaacaaaatgtaatattatactgaagagagaacttacagaacatgtgacattgagtgagattccatattatgatatattaaggaaagacactctatcgcttattgacgacgaattatcgtctatggatttttcgaataatgaagttaaacaggagactaaccagtcggaggattcagaacttcataaactgactttactgattgtagaggataatgaccagatgagaaatgtggttgccgagaatctttcttccgattttgaagtcattactgctggaaacggaaaggaaggtcttgaaaaatgtaaggagttttatcctaatctgataattacagatatacgcatgccgataatgaatggtattgacatgtgtattgagataaagaaagatgaggagataagccatattccgattatagtactaacagctaataattctgtcaagaacagactggacagttataatctggctaatgttgattcatatcttgaaaaaccttttgaaatgtccactttgcgtggggtaataaaaagtatattggccaatagagccagattgcaggagcaatactcaaaaaatgctattatatctcctgaaaaggttgccagtacaaagactgacctcaattttatgaccgagattattaatattattaaaagggaaatgagtaatccggagttaagtgtagaactgattgccgatgagtatggtgtttcgcgaacatatttaaacaggaaaatcaaggctattacaggagacacaactttgaaatttatacgtaatataagattcaaatatgcggctcagttacttcagtctggcgagaagaatgtctccgagactgcgtgggagattggttataatgatgtcaatactttcagacttaggtttaaggaaatgtttggtgtaactcctacatcatatttaaaaggaaaatcagaggatgagagaccgtaattcaaactgtgtcaatcctaaacaagcctgattatctcaaattttactttcggataaacacctgaaaatcagatgtattcgaagtaatatttaactaaataaatgacaagttaaagggttgacacagctctatttacgtagcctacgtagcctctatttctaaataaaatcttataataccctgaaatattagttctttaaagcattgtcaataatagcttttattttaggatatttttcgtcagtatcgccaactttttctctaagtttagccagacgcactttcatatctttcagaacatctttatattcgggatcatttgctacgtttttcatttccataggatcctttttcaagtcatagagttcgaaagcaaccggagtttgtaccaccttatgactgcctttatctcttaaccaccacattgaaggagtgcccattgtcttttcgtcataatgtcttccgttgaacaatatcagtttataatcttttgttcttataccaatatgtgcaggaatatcatggtgaatcatgtgcatccagtatctgtagtaaacctcatctttccagtttgcaggagttttaccttcaaatacatcagcaaagctttttccgtccatatattctggagccttaccgcctgccagttcaatcagagtaggagcaaagtctatattatttatcattaaatcgttatgtacacctctttgcttagattttggatctctcacaataaaaggcattctcattgattcatcatacatccatcttttgtcctgcaagtcatgttcaccaagcatcataccctgatcccctgtataaacaataatggtattttcccaaagtccctcttttttcaggtagtcaaacagccttttcaagttgtcgtccacaccttttacacatctcagataatctttcaggtatctttggtacgcttcgtatgtatcctttttaggatcacctgtatttattttatagtcttctgcgtagcttctgttctcatgtcttcttgaaatagaagtaccgatgaagtgtctcagagagtcatttttccctcttgtagcctcagaaccccatccatcctgattataaagcgattccggtaccggaacttctgtatcttcgagataatatttatatcgtggagcatactcaaacatgtcgtgaggagctttatagtgatgcatcaggaagaaaggtttgttcttgtcacgtctgtttttcagccagtcaatagttatatttgtaataacatccgaagaatatccatttgtctttacctgatttttaggccattctttgttacttatttcatttgtaagaaatgtgggattaaaatattcaccctgtcctccatgaccgttaagaactttgtaataatcaaagtttgcaggttcgtttttcagatgccatttacccaccatggcagtctgatatcccattttgctgaattccttcacaagatattgtctgtctacatcaagtttttcgtcaagtgtaagaacttcgttatggtgagagtattgtccggtcattatgcatgcacggctaggagtgctgatagagttcgtacagaaacaattatcgaatactactccgtcactggccagttcatcaatattaggagtaggattaagttttgccagatggcttccgtaagctccaatagcttgcgaagtgtggtcatctgacatgatgaatatcacgttcatcggtttttcctgagccatactgcacacagtgggtacaactgcaataactgttgccaagctgctgttaaaattaaattttaccatggtatgttaattttttattttatgataaacttgtttttctgttgtaataccctaaatatgtatcgttcatatttcgttatatttaaaggcttataaagttttcaaaatatatgaatctgtctgataagccttatttatatctgtttcattttccggtaacaggtatgctactatataatacactttatctttttcatattctacactatattcaagattgaagctggcatatcctgcaaagagtttcctcgaatttctacaaatttcttttttgtctttattatatattattactaccgcattacaattatagtcggctgtatatatcagttccgtgctatatttgttttctttatttttgagtattctattctccttattagttatatttatgttattgccaaacactttattttggctttcttcagtttctacatttatatctataagagtataagccctaacccagtcataatatgttttattcattgtttcatcagcaagttcctcatcgctagggagctctatccatggatatgggtatgtttccactaccatgtttacgcccataggttcagtaaaataaaatggatcgttagtgtctctattatagaattccacacttcctgattgagtgttgtttagatagaaagtggctgaacttttgtctttccaccaacaaccatacacattgaaatcgtccgatggtacacctccatcctctctgtatagccttgtttctttagctctgatgtctttctgtacattttctccctctggagtaaaccaataatgaacatttgagttcattcctttataaaagaaatttccgttgaaatcaccagtcctgcctatacattcacaaatgtcaagttcttgtttaaacattcccggtgcagctccttcaggttgttttccgtcggtaggaaattttccacttctgtttgaaagccaaaacgttgatgagagtgtcgttttatttgctttgaatctgcattcataatagccatagtgagccttttcttctttagatactacagctgcacatgaaatgttgaattcagtaccattaacaactatcggattgttcatttttataccctcaagtaccatacatccgtctttaaatgaaactctttcctcttcaaatagaccgggttcacgacctttccatgtagggtgtggatttatccattttgactcatccaattcactggcattgaaatcatcagtaaacatatcatttacaatccatctttgcccagtagggggtaaagggattgtttttattttttcacttacagggaaagtattttcgggaaattcttctgtattattattgtctgcaccttcctgattattgacagattcttcttgacctgtttctataataacttcattgcagtttgcgaatgttattgcacacaatattaatatgtttgtaaggctaattctttttttcataattaccaatttaaatttacaacagtagcagaactaaatctgctgccgttgtaaatgattataaaaagtattactttgcttggtttttcatttataataaatttatacgaaaatagcttgtcgaatatcttatttgtgatattgtcgtggtttacttaaactcacgtaatttttaatacaaagcaaatttataacttccgaattgatggaatagtaggtgttttgaaattaaagagtgggtattttcgttttttcagatagaatcttggttttcaaggtatccagattgtacaaatagtcagatgcttgttggtaattaaagcacctgaccataaaaatgatgtttttagttcttataaacaatattattgtctgctttcagaacatatttttttgttttctcagtgtcaatattatgtatgaaggtttcttctgttaatgcagcactattcagtgtaacagttctggttttactgtcattacccgcagtgcttaccaaatccacttctacagttttatcaccatggttcatgattcttatagtagacactagtttgtcaactgttttgtctgtaactggttttgctatcacagtaccattgagttcaattctaagaacatgggcatattctgtaggtttctgtttcgggaatttcactttcagacctatatctgtaagtttgaattcaagcttttcttctgatccgagcatacttacagattttatctccacattctctatataatcttttgcaaacgatttgataagaacttcatcatcccatgcaagtgatattgcatatactttattatcacgagttgtaaaacgaatgtcttgagctgtgtattcggttttttcattatctgtcatataaccggcagttcccttgttttctccttcgcctggagtaacccatggacgagagcaatagattgcttcaccattaactttaagccattttcctatctctttaagaacattcttttgttcgtctgtaatagttccgtcaacttttggtcctacgttaagcaataggttaccattcttgctgactatatccacaaagtcatcgataatatggtctggagttttgttctcctcatcaggacagtagctccatgattttttacctattgatgtatcggtttgccatgagtgtttacgtattctgtcacttttaccacgttcgatatcgaatacctggatattatcaccatagccgaatttggtatttacaacaacttccttaccccagtcaagcgcattattgtaataataggccatgaatttatagaaagtaggctggaacggatattttcctacagtccagtcaaaccatatcagttcaggctgatattggtcaatcagttcgtaggtatgcaagaggaattcacgtcttgacttttcgttagaaccttcatatttaccgtagtaaggagtcatacctttaccttcaggctggtgcagacgttcgccgtaaagagaaatactcatatcctgaacatcggatggtgtgtccattccatattcataaaaccaagcattctcgcatctgtgcgatgataacccgaaatgaagtccttctgctatgattgccttttttagttcgccaataacatccctcttaggacccatatctaccgagttccacttattgaaggtactattgtacatagcaaaaccatcgtgatgttcggctacaggtaccacatactgcgctcctgattccttgaaaagctctgcccattcctgtggattgaagttctcggctttaaacataggaataaaatctttgtagccaaattctgtcagtggaccatacgtttctacatgatacttgttaataggatgtccttctttatacatccatcttgaataccattcgctgccgtaggcaggcacagaataaacaccccaatgaatgaatataccgaacttggcatcttcaaaccatttcggtattctgtagttttgtgcaattgatgcagaatccggtttgaatatgtcagtaccaattggagaagctgtagtctcaatgttgggcttgtattccgaattgttacatgcgcttaagcaggcaatagttgcaactgctaatgaagtaatgattgctttcatttttatagtttttataagtttaaagttctacatttattgttgtcttagctgttttaagtcctttagaagtggcggtwatattywtttttycttkyttkttttyktymgamtgramaawtarcatacacataccsctgratgcttttyttttnkggttytatgaacgactccgttgttgcagcattaccgtttcctacagctctaaagtgtcctgcaccttcaacactgaattctaccagattgtctgcctcagggcatagattaccgtctctgtcttcaattcttacagtaatatatgacagatctttgccatcggcagttattacctttctgtctggtataagtttgatttgagctggtttacctgctgttctgattgttttttctgcctttagttcacctaaattattgtatgcctttactgtaagttcacccggttcaaacggaacatcccacgagagacgatattttgactggaatgtgttaggggcataatgattaaacgacaccataatttcagttaggtctcttccttttacccttttgcccaatgattttccgttaagaaaaagttctgcctcataacagttggtgtaaacatatacaggtatgttcattccttttttccagttccaatgaggaagtatatgaaccatcggtttatctgtccattggctttgatataggtaaaatctgtctttaggcaaaccgcacaaatccactgctccaaagtatgatgatcttgaaggccagtcgtcattccagtatccatgggttgaattatctctgcctccgtatggtgtcggttcgcccagatagtcaaatcctgtccatataaattcccccataaagcgtgggttcatttcctggaaatggaactctatatcaggtgggtatgcccatttgggaccgataaggtcgtagcttgtaacctgatttgtgccgtttttctcatatttctctataggtaggtgataaactccacggctacttgtacacgaggaagtttccgagccatataatggaagatcaggatatagtctttgaacttcagcatatttgcctggtttgtaattcattccagcaatgtctacctgctgtgccatgttgttgtcgaatggggcagggtaatagttgaacccacatgtacttggacgtgtaggatcaagttcgcgacaaatatctgcaagatattttgctactgtaaatccttttttcttatcactttgctcaagaatttcattccctatactccacattattaccgacggatggtttctgtcgcgcattatgaggcttgtaaggtcttttttactccactcatcaaaatacaggtgataaccgttgtctactttagcctttgtccattcgtcgaaggcttcatcaagcactacaagtcccattctgtcgcacaaatcaagaaattccggtgaaggagggttgtgtgatgtacgaatagcattcacacccatttccttcataatctgaagctttctttcatctgctctaacgttgactgcagctcccattggaccgttatcgtgatgaagacatactccgttaaatcttattttttcaccgtttaggaaaaatccgtctttcgtaaaacatattttacggataccaaagtcggtaaaatatgtatctgtaaggtcttttccatcatatatttctgtcttcagcttatacatatatggatttttctgtccccagatattaggattcaacatatttatatatgcaagagtttttccctgctccccggcagctacttcaacattatcatttaatattgctaccgtttccccctgagcgttgataatgctatgcctgatattaaatttcccattgccgaatgttgcgtttttcacagttgtttctatctgtactacagcttttggcttagtgacagtaggagttgttacatatactccgtgttcgggtatgtaaaccttgttgtctactcttaaccatacatttctatagatacccgcaccgggataccatcttgatgacagatctcgcggagtaagctgtacagccaatacgttttcttcacctatttttagatactttgttatgtctatctcaaacccggtgtatccgtaaggatgttcgcccaccttaactccgtttatccaaaccttagcttcgctcattgctccgtcgaagccaattcttacaattttgtccttccattgtgcatccccaatgaaggtctttctgtaccagccagtaccatgaaatggcagtccgccgcatcttgcattgtacttgctgtcaaacggaccttctattgcccagtcatgaggtaagttaagttttctccacgaatcatcatcgaacgatatagcttcggctccttttatttcacctttaaagaagcgccagttttcgttgaaggagataccatccgttactgcgtttattgtgttacccagaatgagcaacaggataattgtacctagaagtcttttcattatatttttcgttttaataaattttctcagcaaagttattttccatattgatatatctgactgctcttgtgtctccatcctcacacaagcctttatttccgtcagttgaataggttgaactatagtacctttttcccatcaggtctacaacataagaaagcttcatgttgtcattgctgctttttataatctcatcagtcaccagtttcttcattgtcgccatatctgatatatgaaccagtgaataatctccggaaactaccgcatcatgcaaaagtttcctgttctttttgaagctcaacagaatcttgttctttctgctttttactccattcccatgttttactaatccgaataattccttgaattcttcgtagttattgaaattatagtatagcatatcattctgaagcaattttattaaagactgctactttatcaaatctgctcgtttttattatcttaatttaaaaatataatgatcaatctatcgaattatctttgtacacgtccgcttgcatcaccaccagccaaagcttcaacttcttcaatagataccaagttgaaatctccattgattgtatgttttaaagccgaagctgcaactgcaaactccaaggcctcactctgagttgctttagtaagcaagccatggataataccaccagaaaaagaatctccaccacctacacggtcaataatcggattaatgtcgtatcgttttgatgtatagaattcttcaccattgtaaatcatagctttccatccgttatgtgtagcagagaatgattcacgcaaagtagagattacatatttgaatccgaactctttggccattgcagtaaaaatacctttgtatccttctgcatctgttttgcctccttctatatcggcatcaggcttgaatcctaaacaaagttctgcatcttcttcatttccaatacatacatcaacatattgcatcaatggacgcataatggactgagccttttctttagtccaaagtttcttgcggaaattaaggtctactgagactgtaacaccatgacgcttagcagcctcacaagcaagtttagtcaactcggcagctttatcagaaatggctggggtaataccagaccaatgaaaccagtctgctccttccataatagcatcaaagtcaaagtcacatggttctgcctcagagattgcagagtttgcacggtcgtatataactttacttggacgcatagaggccccagtttcaagataatatatacctatacgatcaccaccacgagctatatagtcggttctaacaccatatttacgaagtgcatttactgcagattgccctatttcatgcttagggagcttagaaacgaaataagtttcatgtccgtaatttgagcaacttacagctacatttgcttcaccgccgccataaacaacatcaaaggaatctgattgaacaaaacgtgtattgcctggtgtagacaatctaagcattatttctccaaaagttacaattttcatcgtctattatttttaatattaataaataaagttaatttattgtcagaatgaattacttgctatttcacatttaccgcattacccattgcaatgagaaccactcccagcaacatagcaacaagagcaaaatacaataatcccttcgcttttttaggagcatcagcccactctttagtaagaagtccgcctatcaccgccagaaggacagatactgtattataaatggcataaccaactgtattgcctgccgaacctaaagaaaaagcagcgtacgcaaaagatgcagaagcagtataattcaaaaatgccattacaaatgccatccagaaattagacaaacagtattcattcttaaacagaccccacgtcttattcttacacaatttaattacaaaataaggaatagcataaagagctccggaaagatatataatgaacattattgctatagcactcatccattcgggatttccctgtgttacaacagcctctgtaataggagcattacctacagcgtttgccagactgaaacctgtagctaaaagaccacctataagagctatgaatattcctcgcaaagtcttgccagacgaaagttgttccattgaatctttatgttccgaactttcttttcgaagtataccggcacgcccgtttgatactactcctataagaatgattataagacctattattatataccataaagcattttcagaaggcaatccgtcgacaatgaatggcaaaatagaacctaccaatattacagaacctataaatattgagaaacccaatgaaactcctatataatctattgccttgctccatagctgcactcccattccccaaagaaaagatgtcagtaccatgagataaagtacattcgaaggcaatgatgcgagaacatcacaaaaattgtctatcaataaaaatgaagacaccaaaggcattactatcaatgccaggaaaaaaaacagaaaccaggtattctcatatttataacctttaatatatttctcaggcaaagcatacaagcccaacataattccggctcctacagcccataatattccatttatcataattttattctgttaaaaattaaatttaaatattgtatgactctcaaatttctcacccctgtcggtaaaaaccttatttgcatcttttaaattaggaccattaggtactctatgtgtctcacaacaaaaggcacagtacttaccatatttctcactttcatttctttgtaatgaagacgaagtatatttggctgtatacaggagcattccttcttctgtcgtcagaacttccatacttacattactagaagggcaattaatctcggcaaccttctccggaacatcagtaaatcccttatcaaacatatagaagtgctcaaaaccatcatttatctcattatgaacctgacctatattccttgaactacgaaggtcgacgctgctgccagatatgtaaataatattcttttctacactgcctgaaggattcattggcaatacattacttgctgcaacatatgcattatggccttctacattctccataaatcccgaaagattgaaatatgtatggttagtcatggatagtggtgtacgcttatctgtatccgcttcatatctgaaacttaattcgttattattattaagagcaatgataacaaccgctgttacattaccagggaacccctgatcaccatcgggagagaaatacttcaatgttatagagctttcattttcaaagctatcgcatccgataacaccccatacttttttatcaaaaccctgcacacctccatgaaggcaatgggtattgtttacatttgctgaaagtttcacgtcatcataggacgcattttgaatggtggcgcaataacggccaattgtagctccgaaataaggtgcattagaaagaaactcatcggaaaaatagccttcgagggtgtcaaaaccacaaactatattccttttatttccattaccaacaggcaataagacagacgtaacagttgctccataattcattacagagacttctacaccattatcattaacaagtgtatataatgtgatttccattccttcgacggagccaaatctctcttttcgtattttcatatatcatagttttaaagttattaagttatattcttttgataacaccaatgaggttatatcaaatataatgtttgatatagcctcattgagaaaagaagatattaaagcttcttgtatggttcaagcatttcccagttgaactctactccaatacccggttcatctgacgctatagccatacaatcctgaactaccagcggacgacgcgtataacggtctatcggaaaactatggacttctatccaaccggcatgtctctgtgatgatacaagacttacatgcagttcctgcattccatgcgaacatacagttacgttgtgttcttcagcaagtttggctgcttgaagccatcctgttatacctccacagtttgatgcatcaggctgaacatatttcagtttggactgttccatagcatattcaaactcgtgtatggtgtgaagattctcacccatggcaagaggcatgcctgttgcatcagtgatttgagcgtagcctttatagttgtcaggaattgtaggctcttcaaaccaggttatatcgtattgcttgatacggtttgccatatcaattgcctgctctactgtcatggaataatttgcatcaaccataaatgtaatgtcaggtccgataaactctcttacagccttgattctttcaacatcttcatcaggattttcgcgaccaatctttattttaacaccattgaaacctgctttcagatagccatcgatattcttcagaagtttgtccaaagggaacagaaggtctattcctccacaatatgccttacatttgtttgaagctccaccagccatcttccataatggctgaccggcatgcttacatcttaaatcccataaagctatatcaactgcagaaattgcgaatgaagcaataccacctctaccaacataatgaatatgccattgcatcatgtcgtaaagctcttctatattgtctgcatcctttcctataagtgcaggaatcaggtcattgtcaatcatggccttgattgaatagcctcctttaccaccggtataggtataaccagtgccttcacttccgtcttctaattttattgtcgctgttattagctcaaaatagaaatgatttccatgctttgcatcggcaagtacctcatccaatggtacttgaaacaattgcgttttaacagacttaataatatgtgacatcttattattctttataacggatatagaatgttttcttctcaagatactgttcgaaaccatacttgccatcttcaccggcagctccactcagcttgtagccattgtggaatccctgatgcaattcaccatgaggacggtttacgtaaatttctccgaactcaagatcggtatttaacttcatgacacggttaagatcattagtaaataccatagcggccaaaccgtattcgcaatcgttagcataattgattacttcatcatagtcggagaatttcagaacagggagtataggtccgaaagactcttcgtgtacgattgtcatattttgtttcacatcagtaagaactgtaggttcaaaccagttacctttctggaattgctcaccttcaggaactttacctccacatgccagtgtcgctccttctttcaaactgatttctacaagctgtttcatgtgttcaagctcattcttgttgacctttggtcccatatcagatgttggatcgaatgggtcgccaaccttaatcgctttaactttttccatgaatttagccataaattcatcatatatcgactcgtgaagatacaggcgttcattacatgtacaaacctgaccacaattatcaaaacgagaagaaagtgccgcatcaacagccgcatcaatatcagcatcatcgaatacgatgaaaggtgcctttcctcccaactccaactgaacatggataatattcttagccgcagaacggtaaatggcctgacctgccggagtactaccagtcatagtgaccattttggtaataggattttcaaccaaagctgtacccataactctacctgaaccggtaataatattgagaacgccatcaggaacaccagcctttttggccatctcacccaacatcaatgttgcaataggggtttcagtagtaggttttacaacaattgtattaccagctacaagagcaggacctatctttctgcctgccaaagccaatgggaaattccatgctgtaattgccactaccacaccacgcggaattttctgaatcataagatgttcattaggattatctgaagggacaatatcgccttctatccttcttgcccattcacatgcatatgcaataaaagaacaacaaacatcaacttcaaactgagcaaccttgaacagttttccttgctctgtagaaatcattctggcaagttcttccttatttttctttatttcttcaataaaggcataaagtatttcggctcttcttctggctgttagttttgcccatgatttctgagctgcctgtgctgcctgtaaagcaagatcggcatctttctcatcaccgtttgcaaccattccgacaactgagtcgtccgaaggattataaacttcagtatattttccatttaatggtgcgacccacgcaccattaatatattgctgatatgtcttcataagtatttcaaaaaaatagtatttataacaatattatctacccatccagccaccgtcaaccagcatgattgttccatgcatataagcagaagcttctgagcaaaggaataccaccggaccaccgaaatcttcaggagtaccccaacgtccggcaggtatacgagtaagaatctgctcagaacgtactgaatctgcacgcaaagcagctgtattgtcggtagcaatataaccaggagcaatagcgtttacatttacacctttaccagcccattcattagcaaaagccatagtcaactgaccaacagcacctttacttgcagcataacccggtacatttatacctccctggaaggtcaacaaagaagctgtaaatacaattttaccattgcctcttgccaccatatcctttccgatttcacgtgtcagaataaactgagctgtttcatttgtagcaataaccttatcccacatctcgtcagggtgttcggctgccggtttgcgcaatatagtacctgcattattaatcaaaatatcaattacagggaaatcagccttaactttattgataaaatcatacaatgcgtctctgtcgctaaagtcacaagtgtatcctttaaagttacgacccaaagccttaacttctttttcaacttcgctaccttttggctccaatgaagcactaacaccgataatatcagcacctgcagcagccaaagctactgccatacctttacctattcctcttttacaacctgttacaagagctgtcttgcccttcaaactgaatttatttaaaaagtccatattattatttagtttaaaatcattaataatgtaatttgtcacttgttaatttattatttacccttggcagtctaccaaatatttcattccactaggattgcttacgatttcttcgaataatgactgtatatttgtcaaaggctgaacattagagatgatgttttccaacggaagaactttctgattaaccaaatcaatagctttttcataatcttcatattcataaacacgagctcccatgaatgtaagttcacgccagaacatcatcttcaagtctacaggtcttggttgagcatgtatagcaacacctactatacgggcacgcaaaccggcaatttctgtcatagcgttaaccgtactctgaacaccggcaacctcaaagacgacatcagccaaagaaccgttgcttattttcttgacatattccaacaggtcttgttcagctggactgattacatcaaatcccatctctttaagaagctttattcttacaggattaacttcagaaacaacaatctttgcacctgttgtttttgctaccattgccaccaaagctccgattggaccaccccctaaaactacggcaacttcaccggctttcaatccgctacgacgaacatcatgacaagctacagccaaaggttcaattaaggctgcaagtttcaggtcgatatcatccggaagtttgtgtaaagtgaacgccataatgttccaatactgctgcaacgcaccttcgctatcaataccaataaatttaagttttttacagatatggctccaacctttatcagaagcatcttcaagacgattatcgagagggcgaacaactactttatcacctactttatatccttctacaccttcccctatagcatcaattactcctgacatttcgtgaccgatagtctgcgggatagaaacacggctatccatattaccatgaaagatgtgaacatcacttccacatataccacaataagcgaccttaattctaacttcgcctttagcaggtgcaattaattccttttcttttacagtgaaggttttatttccttcataataacttgctttcatttctttataatttaaaacatttaactatttagcttttccaaaacctttggctacaggaacttcaatttcactattataattctgtccatctgtctgaatcatggcaggataatatcggtaataatttccgttagtatatttgtgcaatgacttggacatctttttattcatttcattaaactgtttagtagcttcagcctgatcgccaatcaagaagaaatatttatttgttgagatttctttaccgcccttgtctgtcagtgtgagtccaacatggaacatcttcttaactgtagacagaacattataactgatatcagtgagtttaaatgcacaattctcgcctatcttacttaccttgtagtcagcctctttaagaacattacccacatcgtcttttatacggatagtaacatttgagttcttatattctttataaaggtcgttaactatccatattgcacctttgaagctttcatcattatgccatctgcgccttgtgaaatcaagacatacaagcaatggctgataggctctcttaacaaaatcgtacgatctcttaggctgttggtaggcatctacaataccccacttcatgtcaggccagtaagttatccaatgacaaagggctattccgctaagtcttggtttctgacgtcggaagaactctacaccattctggaatattacaccttgagcatcctgagtagcatctacaaactcctgcaatgtcccattggaacgttcttcaccgaatgtatcgaagttttgcatcttaagcttatccaaatcagcccaatgatgtccccagctcaatccgggaggccacatctcagcttcaggaatgaatttcttgagactctctacattgggtacggaggttatggcaaactccggtacgatagggtaatcctgctttctgtaccaatcctccatcagccatcggcccattgaatagaaatacgccaatgcatgggttgcctccttaggtttataaccggcctcttgcgaagcggcacatgttagaggagaatcggggacataaggcaatggaagataatgctgaagggtatcacccaattgcaacagaaagtcattggcaaacttaacatctctggttctcaagaaatattcctcgcctccttccatcattatgagcgatggatgattacgacgttctattgctacactcttggctacctgcaatactttctctacataggatttttccattggaatattaccggaacccaatggcaacatatcctgccataccgttagacctaatgaatcgcatatctcataaaattcaggtatttcaggattatgccagccaaatattctgatattattcaaattggcttccttggccaaaacaagaagtttctcgtatgttccgggagctgtacgacccacaaatatatttggtgtgcctccccagcatgctgaacggataaaaacaggtttaccatttataactgttgtacgtggaaaacttacatcaacacccttcttaaaacctggattccatgccgaggttacctctctgataccaaacttaacctccttataatcgtgtctcacacttccgttttgagcggaaactctggctatgtacagattctgcttacccatatcccatggccaccacaattcaggtttgccaacatggaaattcttcttatacatatgtttgccgggaggtactgtctgtttgaacttgaccagaataggtttcgactcaaaattatatccctgcacagaagctgttatatccatcgacattggttcgcttgaagtattttcaagcattatctccatatccacatcagcactagagttcttgtttatcctggtacgggcataaacatcgtctatcctaaccttaccggatgtcacaagtctcacaggacgccaaattccgaatggaatcaggtctcgccaatagtcgccgaaccatggagtcttcaaaccgccaagttctgtattgatatgagtaggaggattaagcttgacagtaagcatattagcaccgcggcgcgcatccttacctattcttaagtagtctgttacttcaaaattgaatttctcgaacgctccgtcatgccttcccaaataatgtccgttgagccagacatcgcagctatagtcaacaccgtcgaattcaagacggatatacttgttctttacatcctctgtaacataaaactgtgctgcataccaccattcatagtgctgaacccactgtgctttaactgagttcctgccaaaataaggatcgtctatggctccggctttccacaaatcagtgtaaacatcgccgggaactttagcaggattccaaaccaatgtctcaatatcctcagggaaaattttatggattccctgcttttcaccttcaccaggacgcatcatcttcattttccaattataaccgctcaagtctttaacaagctggttgttcattgaaaatgattcgaagcccggctgcgcatttgaatatgcaataccaagcataatcaaaagcgcagacaagatatttctcttcataagctattattttcgctttgttgattcaccaattgcagtatgagtctgtttagtccatgtttcaaaacgcataatgcattgataattataggtaatgtattgatgagtcaatccccaacgcaatatttcagtaggttccttatcattatcagcacttctgttcagaccaatagcatgaggtgctcctggtataacggacattatctcgaagtttatgccgtctggcgaccactgcaaggtattcttttccggtccgtctgttgtaatcaaagatgctatacctcctttataaggccatacacatatctcgtgtccactattgcttataggattatactctgatttggtataaggaccaagtggattatcggctatagctacaccatgtttgatttctctacctccccaggtaatttcctcacccattctttcacctttataataaagatagaatttaccattgtatggtatgatacatggatcatgcactttatgactgtcaaagtcacctttagcttttactttaaatctattatcctcttctccttcccaaacgccattgtcggatggggtaagaaccggcttatcagtcttttcccacggaccatcaggagaatcagcccatgccatagcaacattttccttaactctaactgtgtatggcgatttaacagtctggtaacaaagataatacttaccattccactgcataacttcaggagtgaaaaccgatctgtcatcgtatgctcctttttcacctcttttaacagccacaccttcttctttccaggtaataccatccttacttgtggcataccatatatcgcatctgtcccatggaaaaaccttttcattttcaacatccccggcaaatccctgagtttcaccataactttttgaataccatacatagtacttgtctccaaccttaatcatagcacttgggtcgcgtctaactataccttcctcataagccaaatcaccttttaaaggcatcatcttatattcaaagaaccacgaattgtcacgctgcggccattccatggcacgtttcatcgcagcacttaatttatttcctttgggtattcccaaagaatccgctttacgctggtcataagcactatcatcagtagacactgtagcagaaggctggtttacacaggaggcaaacaacgctatacctcccactattgttaatacattcttcagtaacataattattataattaaatcatttaacttcaacctttaaatcatttgaactaatactgccagaatttgcattgatgttcagaatgccggccttgtccgtagcctgcaacactagcaatgctcttcctttataggtttttactgtatttgatttatagtttaaaacattcagatgatcgccattttccacacccaataatctgtaattgccaccaatattaaatgttatttccttttcttcccaagaaatatttcttccgttcctatcaatcaattgtgcagtaacatgtatcacatccgtattattagcatcaactgcaaccttatcaactgatagcttaattgaatttgtttctttggtggtataaattgcagaagttgttttcttaccgttctttttacctttagcaactatatttccatctttaaaatctaccgaccacttatagatatgatcctcaaaatctttcaggaagcgttttcctaaggatttgccattctggaatagttctatctcatcgcagtttgaatatatctccacaacaactttttcacctttagtataattccaatgactgtttacatcctcccaaacccaaagtcgttgagtccaaggctttttaggatccttatcagtaaactttccatccttttcaacataagaagacttgttggctgtctgagaatagatagcaataaatggcgcatcagtccaaagtgatttcatcatatggaaagaaggtttttcaaatcctgccaaatcaagcagtccacatccgatagctctttgtggccattctctaccttttgttccaacttctcctaaataatctacacctgtccatataaacataccagggatatagtcacgttcgataaccgctttccattcatgccactgaccgagattttcagtacccattgcaggtttgtcaggataattcttgtgggcataatcatacattactcttctatagctgaatccggctacatcaagagcatcaatatatcctgtctcataacttatagaaggaagtatacaattagctgttaccggacgagttgtgtccatctcacgagtccatgctgccagtttcttcgctgtgcgaccaatatcataagtctgcttaggctgtttagcccactcttccctgattctctgagttgaataaggaggctggttccagaaatatccaccaccggcatctgcactaaagaaacctgttgactccttacatcctttataagtccattctatttcattaccaatactccactgaaatatacatgggtgatttctacttctaagcattacattcttaaggtctcgttcggcccattcctgaaaatattcgcagtatcctcttgttatataatcaatggactgttcatccatgtttaatcgcttatcttttggataatcccattcatcaaaaaattcttcctgaacaagaaatcccatttcatcacaaagctccaggaaagcatctgcaccaggattatgtgacaaacgaatggcattacaaccaccatcttttaaagtctgtaatcgtcttctccaaacatcttcaaccaatgcagctccaatcatacttgcatcatgatgaagacaaacacctttaatcttcatgttctttccgttgaggaaaaatccttttttagcatcaaactttatacttctaataccaaaaggagtttcttttgtatcaacaacgttaccatctacaagaatttcgctctttgcaagatacattgaaggagaatcaacatcccaaagggaaggatttgatatttctaccgactggttgattttcatttcctttcctgcctctatcaaaaaagatgtcagtttctcgcctactttcttatttttggagtcaaaataagaagttcttacttcacctgctcttggtccggaatagtcgttcttgacccttacctcaatatttacggttgctctttcagaggaaactacaggtgtagttacaaaagttccccaaacaggaatatgcaacttatcagtaaatatcaactgagtttctctataaatacccgaaccggtataccatctgctgtctgcatatctggaatggtcaattctgacagaaattctgttttcttgtcctttcggattcaaataatctgaaatgtcataaaagaatggagagtatccatatggatggaatcctaattttctaccatttatccaatattcagaattattgtacaccccatcaaaaactatatagcatttcttatcaacgaaattgtcgggtgtatcaaatgttttactataccaaccaattccacctttaaggaaaccggtgcaaccttccgctgtagactcaaaaggaagatcaacactccaatcatggggcagattcactgttttccacgaagacggattatagtttacaaatgaataacaggcagaatcagaaagtgtaaacttccacccgttattgaaatcggaattattatttaacgcataagcgttggtaaaaagactggtcagaagaagactgacagttactaaatgttttctcatggttttaaaattgaacattagtatttgattttctgatgcaaataaaaaataaagtattgatatggatgatgggagaaatattaaaaaaaacatggtgtttttatatgcatggtatttaaaaaccagaaataatgtaaatgagaacagtaattactatataatattgtgcttaaaaaattacatcctaatggacaggatacaaaaccaattcaacaataatttcgcagtcataaaaatgatttctaacaatcctagtagaattcaaattattaatgcgaaaattttttataatcaatctattctatcatatcgcataagttactcagaaagaaaatatacctatcattaataatttaggtttctgtaaactttgtacttcatcccaagtaatcttctcttactcccaccacccctttaaggtatgtcgctaaagttccttatctacccagagtataatcggtataactcgtttttctattgtctttcattggtcttttctgctgtccgcttcctcatttatcggtgttcccccatctaagagcctttctttttatacggcaaaggtatatggtcgtggtggaaatgaaagagttccggcctgcagcctttgccctgaaaaaaataacgatgttgtctgcgactgccccaacatttttttcgttcaaaacttttctaattccactcgcccgtacctaaagaagccgtaaaaaaaaggctcaaactcagatggggaatgattctcaatctaaaaaaaagtcagcggacaaaagaccaaaccaagacaaaggttttcaaaaaaaaggtctaaatctagctgaagaataattcaagtttttaaccctctaaagcatacggatatgagaaaaggtttcgaagttaacggcgattacagactgatggacagttcagaacttgtgtatattcttaccaacagcgcagtgatggtaaacaaggtacaggaaaaggaagtggtttatggcgaagagtgca

SEQ ID NO: 69 - DNA, 52469 bp, Artificial Sequence
  Synthetic sequence
  misc_feature (220)..(220): n is a, c, g, or t
  misc_feature (8966)..(8967): n is a, c, g, or t
  misc_feature (8986)..(8987): n is a, c, g, or t
  misc_feature (12054)..(12054): n is a, c, g, or t
  misc_feature (12080)..(12081): n is a, c, g, or t
  misc_feature (12087)..(12088): n is a, c, g, or t
  misc_feature (34597)..(34597): n is a, c, g, or t
  misc_feature (34617)..(34618): n is a, c, g, or t
  misc_feature (34661)..(34662): n is a, c, g, or t
tgccaaagataggtatattccatttgaatttaaggcttccgatatatctcgcaaatttacctatgctaatatacagagccattttgatagagagcctttattgcatgataacacgatatacagggtaggggagtggcgagagtctttagaacgcgataatgagtatatgtcacattctgctcttccttttataccggatattgatattactggcggtagncaggraaaataragaagatgatcttycgcctttgaaacggaaaaagaaacataaaaataatgatttgtcactttaaaaatatcaaatatgaatttccagtcgcttttcaaagaatatactccagtagagtatggtgatttttttcgcctttatagaatcaacaataggggttatctcatttattgtaatgaaaataacgtaatttgctgtatggaattatacggttttacggatatttcggttattatgctggctgaattactgaaggttaatttagaagaattggaagattgcgaagagttttccctgcctgttcgttgcagcagacaacaaataatagattatttgtttgatgtttcggcaaaagaaacatatgtgaaactaaaacatgtatctggactgcatggctatttgctcaaatctatacatcaggataaatctggactgaatgcctatcgcaatctttttcaatttgatccagttaagggaaatacaagacttttgtttgacgataatcagtgcctggcttcaatacgcacagataagtctggctctgtatatatctgctgggatcctgtcttgttctttggtctggataaatccggtgatccagactcaacaggatatttgctttcttcatcttcaactttgctgattgattatgttttgtcaaaaatatcttgtgatagagatataatagtaatggctggtagcaattatttagaggctctgcttcttatttcttctctcgttacctcacaagatctttcttataaattatctgttagttatgatgatatgaatgtgaccattcagttcttgaactggcctactcctcaaaagattattaattttatctctcagcttaataagcatataccaaacggttatgaaaagctttcgtgtgttatggtaaataagaaaatatatttgcaggttccggctatccggtcttatttaaaaccgttgctttatttatattatgatttgttgtgtgatggctctttaaaattgtcattattgaaatctgatgcttcctaattattatctttgtgcctattttaatgtatttattatcaacctttataaatagctatatgacaaaatctgaattagttaaacaaatatcttattctactggtatagattacgcaacagcattaacagtagtagaggcattcatgtctgaagtaaaatcttcattggcaaatcaggaacctgtctttctaagaggcttcggcagctttatcctgaagcatagagcagagaaaaccgctcgcaatatttgcagaaacactacattaattgtgccggaacatgatatacctgctttcaaacctgccaaagagtttgttgcttcaataagtaaattgaaaaatatttaatatgtacggttttatacaactatccatttatctgtatcacaactatctgtagatggtgtatgattaggataaaattacacaactaaattattttatgttatttttgaatttgtaacataatcaaaatatgaaagatcaacttgctttattaagaaaatgcatcgtaaatgatataccggctatcgtatttcagggcgatgacagctgcacagtagaagtattggaagcagccattgaaatctacagaaggcatggcgcttctcgcgaatttctgtatgacttccagaatgtgattgatgatgtcaaggcttatcagatacagaatccgcacagattgaaactggctgatatgactgaggttgagaaagaacttcttcgtaaggaaatgctggagaaaggtctactgggatgaacataaaacttaccatgtattctgctgacctgagcagtgaactgtcattgccgtttgcagatcaaggtgtgagagctggatttccttcaccggcccaggactacatgactgacagcatagacctgaaccgggaactcatacgtcatccggccacaacattctatgcccgtgcttccggagattcaatgaaggactgtggtattgatgatggcgacctgttggttatagacaaggccttggagcctcaggacggtgacatcgttgtggctttcatcgatggagagttcacgctgaagactgtgcgctttgacgataaggagaaatgtatctggctcgtaccggccaacgaggaatattcacccataaagattactgaagagaacaactacctgatatggggtgttcttacttataacataaagagacagcttagaaaaggaagatgatagcccttgtcgattgcaataacttctactgttcatgcgagcgcgtgttcaatccgctgctccgtgacaaacctgtcgttgttctgagtaacaatgacggctgtgtcgtggcccgaagcaacgaagttaaagcaatgggtatcaagatgggtacacctctctaccagattcgtgaagtccttgaggcaaacaatgtggctgtcttcagctcaaactacaacctgtacggtgacatgagtcgccgggtaatgatgctgctgtccgagttcacgcccgaactgacccagtactcaattgatgaagcgttcctggatctctccggcttcggagaaggggagaagttggtttcctacggtcacaggattgtgaagaccatcggaaagggtaccggcatcccggttacgatgggtattgctccgacaaagactctggcgaaggtggcaagccgttacggaaagaagtacaagggatatcagggtgtatgcatgattgattctgaggaaaagcgcatcaaggcgctgcagggcttcgaaattggcgatgtctggggtatcggccatcgaagcttggataagctgcactattacggtttaaataccgcctgggatttcactcagaaaagcgagagttttgtgcgaaaataacttacaattaccggtgtacgtacttggaaggagcttcgtggtgaatcctgcatcgatgtcgaggaactgccacagaagaagagtatctgtaccagccgaagtttccctgactccggtctgtccgaactctccagcttagaggaagctgtcgccaacttttcttccgaatgtgtccgtaagctccgtatgcagcacagctgctgcacagagataacagtattcgcctataccagccgtttccgtatggatcttccgcagtactgcatcaaccgcaccatccacctgcaggtaccgaccaacgaccttcaggaacttgtaagcactgcagttcgggcactccgcatggatttccgcaaagagggcggttatcagtacaaaaaagccggtgtcattgtctggaacatagttcctgattctgccatccaaaccaacctttttgacaccattgaccgtgacaagcaatcacgcctggccgccgccatagatgctatcaaccgaaagaatggccacaacaccataaaggtagctgtccagggcactacagataagtcatggcacctcaaatgcgaacacatcagcaagcagtacaccaccaacctcgatgatgtcattctcgtgaagtaaaatatggtgctgaatgtagcttatttatttcataattacagctataagtcaattttaatatctacatttgtatagtttgtataaaaacaatgatatccttgttgaatttttatttcgtaacgaaatcaaagttcttcaggagtataaggaaaaagcacatcgggaacttagccgggtacgtgatgaacagaaaacattcgggaaaataaaagtaaatacagaattatgaatcagttacacataacattagaagagaattcacctgctattaaatgggctaatacacaagctgacagaataggggcaagaggacatgtcggtactcacttggattgttatacaacagtaccagagaagcctgaatacaatatcacagcaatggttcttgattgtcagaatgaaatgcccaaagaggaagatattaaaagtcttaccacccttgaaaatatggctttactgttacatacagccaatttggagagaaacgaatacggaacggatatgtatttctccacagaaacctttctgagtgaggaagtccttcatactattttggagaagaaaccgctttttattatcatcgattctcatggtatagcggagaaaggaaagagacatatagaatttgacaagatttgtgaagctaatggctgccatgtaatagaaaatgttgatttatcatgcattggcaatcaaaaggaagttcagttgaaaatattaatcaatatcaatcaccaatcaacgggcaaaccctgtgaattgtattgtgtgtagtcctttcccctgcttataactttataaaagcctttggggagcctaatacccctgtatcaaaaatacagggggcaaggtatccctaacgcaagcatgtatatgtaaaatcacatacccattccaaaaccccggcttcttttcctgggctggtcgagttcttcttccagctgcttctttctctgcggtgcctggttgatatctggaacctggaatattatactatttccctattgttggttctcttcacgggctattatttctttttgtccaataatgtttggggtaatatatattttatttgcttttatcagatattcttcgtaattttataaattcaggcagaggttctggtaatagcctattacggaagacgtgcatggctatgggcggttagggtaacttaaccgctttttcttttcaaattttctttgttaatagaaaatttctgtatctttgctttgtcataagacataaataacttcttacactgtcattctcattcatttcttcaattcttgacagtagtaaatcaaagcacattataatttaagtttatagctgcatctgcagcctatctatcgcaccctctccaggctgtgatagatgtttcctcatttattcacttttcattaatcatttaatcaatttcattatggaacaggtattaattggccagaatgccggcattatctggcatctgctcgaaggtaaaaatggtgtagaagtatctctttttaagagggagtccaagctctcagaatctgagttctgggctgctatcggatggttgtctaaggaagacaaactttccttctctacagaaaaagtaggtaagaagacagtgaagacatactctctgaaagactgattcattgtgcgctcatgctgtaggcttgcttgattcctgatggaataggcaagtctttttttttacaataaattttataacacaatacgttcaaattatttaattttgattttgtgacataatcaaaatttactatttttgtcccaaaccacacaaattagcttatatggaaaataaatttgaactagttgaaaaatataatattgatgtggatgtctttattgaagaaaacggtgtaactcctgttggaaaactccctgacaaccatcttaccaaagagttttttcgcctatattttactggacagattacaaaggtctggaagagatggctttctgaatgttggatgcaaactccttaatctacagacctatattagacgggaaccgctatattacagaacaagaattatcaaaagctctcaaaataacaaaaagaacactcattgaatatagaatgaatggtaaattgccctattacagaataggaggaaagattctgtataaggaacaggatattatagaaatattggaaagaaacaaagtattggcatttgaataatatctcttaaaacattaataatcaaaagataaactttataaaatagcttgtagctacccctaaataattatataaatatttggaggaatagaaccgaacacttacctttgtaaagtcaaaggatgattaacgagaatctatcgaaaattggtgaatttggcatatggctgattcagtggttcggggatttttccaaagatattaaagtgctgtaatttaggactttgaatagtattattcgattccttgaggtaaacagtacgctgaactctacatcaaaaggacaagaggattttgtagatttgaaaactatatcaactacttcatattttttaatttcaatatactttgaactctttactctatttaaggaggcaaaagcatgtattgatatagtaacagagattatcaggataaagtaaaatttcagtttcatagacctgtgttcttcataaaaaaatcccgtataggtcctatagaaccatatacggaatatataacccccaaaaaatcatcaattcatattttgtaaatatctattgtcgactattctttcaagctcttttttaagtttagcagccacctcaggattcttgtcaatcacattcactgattcactcctgtcgccattcaacttaaataactgatcctttggactattccccaactctgtattagtctgtacattcaaagcaggagcattatttctaggaataaacttccattcgccatctgttatgccaaggaagttctgaatattctgtgttacaaaatattctttacccttttccgatttacccaaccatgcatcaagaagattctcactgtcaggcgctgcaccatcaggtaaagttacaccagtcattgcagcaaatgaagcaaaccagtccaattgagacataagcaaatcgttaacacctggtttaacgtgatttttccatctcaagatacatggaacacgtgtgccagcctcatagttactgtacttgccacctctcaagtcgcctgcaggcttatggtcgccaagtaattccacagcctgatccttataaccatcatctatcaccggaccgttatcacttgaaaggacgacaattgtattttcgtcaatacctaatctttccagagtcttcataacttcgcctacaccccagtcaaaagacaacaaagcatcaccgcggagaccgtgtccgctttttccgacaaatctttcatgcggatcacgaggtacatgaatatcatttgtagccagatacaggaaccaaggtctatccgaagccgacttttcttcaataaatcttacggcattggcaatgatactgtcctgaatatcctgatctctccataatgcagatttacctcctctcatatatccaatacgtgaaataccgtttacgatactcatatcatgtccgtgagaaggatgaagtcttagcaactctggattgtcttttccggtaggctcgccagggaaattcttggtataactaacctctacgggatcatctggtgataatcctaaagctcttccgttttcaatccaaatacaaggaacacggtcagctgtcgcagccattatatgcgagaattcaaacccgatatcgcttggatttggagaaaccaatccattccagtcctgctgaccagccttatcaccaagaccaagatgccacttaccgatgacacctgtcgaatatcctgcatcaacaaacatatcagccatagtatatatgtttggcttgataatcatagctgcatcacctgccgctatcccggtacctttctttctccacggatactcaccagtgagcattccatatcttgatggtgtacttgtagatgcaccacagtgggcatttgtaaacattataccctcagatgccagtttctccacatttggagtaataatcgattttccgccataacagctcaaatcaccgtaaccgatatcgtcggcataaataaacaatacattaggtttcttattcacttctgcagcgtcttttttccctccgcatgaagacagcactgctgcggcaattgccggataaaaaaataaatcagttctcatatgttttttctatataggtttataaattcgtttcatcatcattaactgtaacctccaaaaatataactcttctgttttctgtaacagttctatctccaacgtaatacatttacctttaagtcttcatacatgcaaactgcgaaatatgcccgatgccataaggtatcagcttacggcacttttctaagcttaacttaccattctcaacaattaatataggtcttataccatgaatttgcgcagtaggttcatcaggagataataaattatagacagaatcaacaatggtacgaatgctatcatctacaaaacaagtcctattttcgaaaggaatattaatatcttcatcttcagacgatttctccgaacacgaaaaaataaattggtagaaaaaataaaagtttattcataattagttttaagtttttatatgaacacaaaaatataattaacctaccagactagtcgtagatatttctttcgaaattagggggtatttttattttattctatccctttttaagataatctccttctgctttttagtcaatccccttcgatataactcttccaaagaaaaaggaacatcattctttttcatttccggatcattgaaatcaatactcaaatcacagtcgaaccgcaataaaatacttcttctgtttcgaccccacaaattataatgggaaataccccatgttatgccattagcaaacggtacatccgtaaaggcatccgggtcataaagtcctgaagcaattggcatcatggcacaaatacttgcaaccttgaaattcttgccatcctctgaatattgaatagtattattttcatgcccgtctttagccataatcgaggctatcccctgcttgaaacggaaaaactgagtctcatgyccggaactgataatcggkttcaattcatwttttttgaatggycccatagrattatcagytakggnnaagmccckgagrgvgratnnaaaccgccattatcctttccgttataatccgatttataatatagatatattttccctttataaaccaatggttgagggtcatgaatagaaaattgatcccaatcaccgggttcaccgtttggaataatgatttcatttacgggagtccatggtccgtcaggcgaatcggcatacgacattgcaactgggcagtcatcacgaccggtacttccgctcattacagaaaaggcctgataatataaataatacttgcctttccagaccaatacatccggagttgcaaccgacctccacccaagttccggtttcttcgggcgatgtacagctatcccctgttcttcccaatgaaaaccatctttacttgtggcatatgcaatatcacacaagtcccaatccacagacggaatagtatcattagcaagctttgtccctacaaaggttgttggagtgcaacgcttggtgtaccacatatagtatttaccgtttaccttaataattcttgaagggtctcttcgtgttactgtcccatcatcattatgatagtcaaagcctgtaagcggtgagtacttgaagttcgtgtataattcattcaactgtggagttgcagctccgtaattatcatacactctgttcatagcgcaactcatcttgaaagttggcttttctttaggcataacataagggaatggattctgtgcaaacaagtctgcagaaactcctatcaatactgatactaaaagctttactctcatactataaaaatattaataaaaaaatcaattacgaatatattgataaattaccaaacctaacataggtaaatttaaagtagatagtatgtattttaaaattaaagatttttttctctttatcttagactagaagtattcagtctacatacatagtattgatactatcatcaagaagatcattcttttcacacaatccgccggtccaggtctcatcagcagtccacaaatcccatatgatattcagttctagagtaaaatcctgttttgataccacatttcctgtaggttcaccattcaagtaaaattgaatattgttggcatctttccaccacactccaattctttggaacttttcattccatttcactccttttgccggatttccgtcagagagtttcctgttatcgaagttaccgttatttctttctgtaacaccattcttgacaacaaagtattgcgaatacatagtataaggacgtgtattctcctgtgccttaatagaaggttttgagttatgctcacacatgtctatctcatccctgtcattattgttgccattattcatccagaaagtactgaaagccgaaatatgtgcggtacgcatataacattctgtgtacatcggatatgaaattctcgtattcgacataaccctagaagtcttaaaccacctttccttgccatcgtcaagtgtagccttgatccaaagcaaaccgttatctactcccgagttctcggcaaccatctgtaccggtacgtcataattccataatgacctgtgccattttgtagcatcccagtaatcaaactcatccgaaaggctttccaccttttcccatttaaaaccttccggaacctccggaaggttttgcgcattacaaacaaaatttgctgaaaacatcagcgacaaaaatgatagtaaggtcttcatcatatmcctctaatattatttraaaaattaaaaatctgcatagtamctgtacttvcgtgaccgccattatctgggaactttaacgagatagtattatttcccttaagaatgctgtagtccacaggcacttcaataacaccgaagaaagaagcacggtctttctgaacgtcacccctgaaattatccgggatatcaactttcttaccgtttactaaaagttcaggcagcaacgacaaaccatgatttctgccaagtccaagacggataacggcctcaccatattcggtcttcttgacattatttatattgaaaaccagttctttgccagcagcaatctctttaaggtaatccgttgcataatatttcacctcctccatcgtttcgtttattttcacttttctgtcgaaattatagcaaatgacgcatgttgcctcagtttctaaagtaaagtggtcaagactctttgcatcgtatacatcaagcataggtactccgtctttcccacctttaaggtacagatgtctgacttctatactttttgcatccttagatgttccgtttacagaaagattcaaatctactggtttgaaatccagattgtttataatgaaatacacattcttcccgtctacatatgcatcacacataatgtcaggattatcacagtttgtttcaacccttgtacccttcacatccttccagagctgataaaactttataagttcagagtaaacatattctccggtaaagctttcaggctcgttttctcttctcagcattctcgctgtatgtgcaagacccgttttgggattatatccccactcagatttgagcatggcaaaaggcatggcataacatatattatcggtcctttccataaactgcataagcatcgagttggtcgatttcagtcgcagccagtcgcgatatggcgaccatggcttcctgttgtaatcatgcgtctgcgcactgtattccgaaatcataagaggtttaacctcaccaagctttatcatactgtactgctcaatcatatccattgtggcctccatgttactgccttttctgtacatctgtttaccatctttacatggaaaatcgtataaatgaatagtaaagaaatccatatcctttccggcaatatcaataaactgtttccatctggcattccatcttccgaaattctggagttcaaaatcagggaaggcagtgcaataacctcccactttcatatcaggattaaactttttcacctgtgcggcaatagtagagtggaattcaaataatttggttatacttgactttggagctttcggcttatcataaatatcccacaaaggctcattaattmcctcacagamcccaggcttaggttcmccmcttntcyccycctycacmaaaatmctcctnnaatatnncctgccataaaattcacccgaagctgttccgaaaggctcatcttcagtatccttctgcgataaagcccatcctttcagcgttttagttccgtcaggataaaaaggagagaactgattacaaagaatcagattactgtatttctcgtaaggatgtacctttgtgttctgaacataccgtttcttattctggctacatagtctagccaaatcatctgggtcggcaaaacctggtctttcgggatcctccttaacattgcgaagcacagtcttgatcatacctgtttcacgccccacatacacatcatattttcttataaggtcatcacgtaaatcagcaatcttatttgcactatcccaataattctcatttattgtagcatggaaatttataaacttaggacggttaaactctgttacatccccaagcttatgttttacattcaaattcaattgcacatgagtctgtgcagaagcggctaaatgaacagccataaaacaaaacaagccgataattctgtttttcataaattattttatattaaagtacaatattagtaaagtttatggttttgagaataaaaaaatgctccgttattgaatatcatctaacggaacattttatttgaagcaaagaacttttatcttgatggttcaatcaatatgtctttttccattatactgatattatcatactttttaaccagaataccattttcatcatattcagaatttttcagtcggatattgtatggcaaatatatatcatacaaatagtatttatatatggcaaaatgcaacttttccctaagtaaatgaaaatctctcccataaagatattttttctccactataactagaataaatcaaatccttaactatataaaaagagaagagaccatctcaaaatcattttgagatggtctccataaaataattatttatcctctaccggtttataaattcttatccagtcaacaaggaatgtattattatctttattcattaattctttgtttgtcggagacaatccacttatagctctccagctctggtcttccatgtttataattatatccatttctttcgatagtccggtacccttagtaaaatcattggggtcaataatatttttcccagatacccttcttaccattttaccatcaacataatattccaaattaaatggatctttccagtaaactcctactctatggaaatcatttctccaaatagttccattcacatctttataccaacttccaggatctgttggttgatagtcctgaaacggatctctaataaacacatgatgacttaaatgaattctatcaggtccgtaaaatttatgtccatcatcacctacaaccctatcgctaccatatgcctctataatatcaatttcttgagtatcatcaggacttaacatccatacatccgaagccattgttgagttagctatcttggcatatgcctctacatacacaggatatactactctagttttagatgtaacacaccctgtataagtgccaggcatcattttttctttatctccgcttgtaaccttaactatttttacatcgtcaggtctactggtttcaattcgcaaacaaccatctgagacagaaatatgatctctctgccatattgtaggagctggtcctgaccagttggcatggtaataatcggtccatttcttttcaaaattacctttgttattactgtcagcagtatagttaaagtcatccgactgactctgtaattcccatttcattccagtacctgccgaaactggtacaggaaacttgtcccattcatattcaaattctgtttcagaatcacccgggtctgtatttgatccgttttctgacccattctcttctccattattatctcctggcatacaggaactacaagaaataaataaaaatcctaatgataaaagcaataatttcaattccattctacaaaaaatttaattaataatatctaagaaatagatagggagctaaccctatctatttttaatttactatggacgtttttctattttagtcaatgaaatatcatcaaaatagaaattcaatgctgatgatgatttttcatttgtagctctaatgataattcctgaatctccagctttggaagatgacattttacatgtaacattcacccattgacctttaacaaaatcattattaaaccatacaccagtactccattttgtatctattgcaaaatcaaaagtaatatttggatatattccatttactggagtaccatctaattcttgtacatttatccacatagaaagcaaataatcaacatttgcttctacagggatggcataatctcctgctactttggtatcgcaacccattatcattcctttaccagcagaaatttctgcatatgcaacaccgttaccagaatgagcattatcatttaccatagataatttatagtcgtcccatagagttgctccccaagaaactttatcccaatcttctacagtacaattttcaaaacctacatcatatcctgcttctttcaaaagatttgacatcttgaaatcgaaactttccggttctgaaataaaatttgtagcataaacatagtcaagtgttatcaaattaccaacagatgcatcgtatgaaacagttatattatcggtattataaatatcagtatctaatacaagttttacaatattgacatccgtacttactgattgaatatttgcaactacaggaatcatattttccccgttggttatattcagtgaaaaagcattaacaggacagtctgatgcatctttcattgcacggctaaatttcaaacctatagtattggatgataatctttcagcaccaataaaatcaacaggatcttccgaagctataacatttaccaactctgtatattttatgctgctacgtccaaaatcacttgatgactccaaggtaacctcatacaaccccggtgagtagaactgataagatgcaataccgtcaactgcctcaactgtttttgcctttccatcttcactaacaaaagtgaagacatttttattaggtgcacctgtagaagtaacagtaaaatctatgtgatgaccaccttgcagctcattcttggcgcccgaagctaaatttatttcagcaccagtttctctacacaaagcggtaaatgacgctctaacactatctaaaaccgtaacttcaacaaactgttccttttcattagtaagtccatcctctgtttctatttccttacagaatatttgtttaagagaaatcttatgaactccaggaacaataaaactaactttcaggttttcggatgctgaggttgtaacttccgtagaatctaaattaatggctacaccttcagggaaagtccatgttctggattcaacacctcttgacaaatccagaaatgacatccaaccattaacttgcatcaaattcgctttatttccaaaagaagtagtaacatactcctggactatatcttcgttaaactcatagtccttttggcaacttattcctaaaaaggctaaaataactaataatattttatttattgtcttcatcgtattaaaatttaattctgtaatgctttattattctgaacttcacagctaggtattgggaaataatcgtgaacatccgactgatatacctttgaacgcatctcaaaatcaggacgcacacgttccttaacatttaatggtggaatctgttctgtagaacttattgttgtacttgtaatagacccacataaattcaaacgtataccttgttcttcactccaacattgttcgaagcactctttaaccaatccccaacgaaccaagtcaagccagcgatgaccttcaaaagccaattcaagcaaacgctcagccattcttaaatgcatcaatacattatccttattggcaggaatcatctcaaagtctgtgtaattatttgcaaatttagagacccacaatttagggaaaaatccattattctctgttatataatccttaagttttactacccctgcacgttctcttactttatcaatatattctattgccaaatctacatcaccatcatcttcaagaatagcttcggcatacattaacaaaacgtcagcatatctaatagctctgtaatttatacctgttctacatcctgtagtaggatcctcagattccactctatcccaacgtgtccatttccttactttagaactctgaccatatccaaagtttacttttcctttggcaacaagatttccatcagcatcatattcatcaacaagaggagccttataataatcaccgtcacctttctcaactacaattgttgcgtatgttctcatagagttcaaatgtccagcttttgtccattcagcatcaggatccataacatctgccgaaacaaacatttcgtggcaatggtaggtaggtaacactgtattgtaaccacctgcaaaaagagaagcaaactggtttgcaatagatacaccttccgaaccatctatctcgtcatgcaggtttccactatttcctggcttgtagttatcggagaaagagacttcaaatacagattccttattaaactcattatcagtggtaaagttatccatataattttcttccagttcatataagttgctttcaactaattgcttaaagcattctcttgccaacttccattctttctggaaaagataagtcttacccaacatagctgtagccgcaccccaagtgatatgtccgtcattaccgttgggccatactttaggtaatatttgagcagcctgaaaatccggaataaccattttatttattacatcatcctttgatgaaaaaggaatgttcatttcttctgccgaagaagccattttatcatgtattacggctccaccataagtattggcaaggaaaaaatagtcatatcctctaataaaacgtgcctgagctattatctgttctttcttctcttgtgtaaggaaatctgcattttcaatgtaatgtaatatttgatttgctctgaaaatacctacgtacaattgtgaccaacggttttcaacatatggtgaagagctatcccactttaactgggtgaagatattttgagtactataccatgtttctgtacctgccaaatcacttcttagcatttcgaaagtcaatcctgaaccacttacatattccaactgcaaagaaccatacaatgcatttacagccttatcaaagtcagcttcggttttccaaaacgagccatcagtcagagaattgggattaacttgtgacagcaaggcatcttcacaactcgtaaaagttcccccaataagagagaaacataatatataagctaatttctttatcatagttttaaaaatttcagttaatcaaattaaaaatcaagctgtacaccaaataagaattttcttgttataggatagttggctttatcaacacctcggcttgcaacaccatctccaccaacttcaggatcatatccctcatatttagtaaatgtaaacggattttgtgcagttacatatattcttgcataatccaaaatacctttaaaccactttctaggtaaagaatagcccaatgttatattgcgtaatcttaagaatgttccatcttccagaaagtaatctaatctaggattacaattatatggttcaggtacaggtatatctgagttgatattgtttggagtccacatatcatataattcaacgtgtcttactcctgcgtatgcaaactgttttgcaccgttgtataccatatttttatgtgaataatatagctgagtagaaaaatcaaaacctttataatcagcattaaaagttaaacccatttcaaatttaggcatactgcttcccttataaacacgatccttatcatcaattatattatcaccattctggtttaccagtttcaagtctcccaattttgcatttggcatataagacttaacagcatccagttcttcctgagtctgtattactccatctgattcaattaagaaaaatgaaccagcaggataaccaactttcatatatgttgtaacattatcattattcaaccaggaaccaagtttactattagccaaaggtatttcattcatatcacccaacgaagtaatttcattgatatttttagtgaatgtccctatcaatgaccagttcatgccaaattttgtatgtcctttgtatgtagccgagaactcaaaacccttatttaccatgtttccgatattagaagtaattgagttatttccccaacctacatttgtaccagatgatgcaggaataatcacatcaagcaacatatccttcttattattcttatacatatcaaaactcaagcttaaagctcctcttaataacgaagcatcaagaccgatattctttgatacatttgtttcccatactatgttaggattggaatacgctctctgtatagcacccagacctaactgatcgcctgtttccggtccccaaacataatcaatctggttgcggatgtaagatgcatatttatagtcaccaataccttcattaccaacctcaccataactggctctcaatttaagattgctcaaccaatctacatttttcaagaacttttcttcattaatattccaacccaatgaaacaccagggaagaaagcatatctgttattcttagccattcttgaagaaccgtcgtaacgtccactggcagataacatataacgaccgtcataagcatattgtaaacggaacaactttcctacaattacatgagtagatttagatcctccaattgatgtaagaacatttcctgcatcgaaaacaggtgtatcattactaatgaaatcttttttagacattgcgctctgcacccagtctgtcttttcaatagtataaccgattacagcacctactttgtgctttccgaatgttttatcataacttaatacattttccatagtaagtttcatgcttgaattatcctcctgcaaaagacttgcatcaactctacttgaagctgtgttaaggttcccgtttttatcataaaccataaactgaggttcaaagaaatctcttttatattgccaatagttataacctaaattcacctgataagtaagaccgtcaataatctctatcttaaagtttgctgctatattatgagaattttcaactctgtcatcagaattagtcaatatacgagccaaatatcccaaatgttctacgttgttatcagcatcaatttctacttcacttccatcttccatattcaatggtttcatatatggtttctgatattgtgcaaactgatatacattccaaggctcaacagatttatcagaatgatttaagccaatacttacaaatccactgaaacgacctttcttaaatgttgcatttgcacgggtagagaatctttcgtaaccggaattaataagaataccatcctgtttgaaatagttggcattaacattataagtcataacatcactaccgccacttacagtcaagttataattttgcattggggcattatctaaagttactgatccaataaaatcggtattataatccattgcatcgggattataatataagtcggaagagttaccacctaaagcacgctgatacatttcatcaacatacaactgctgtggtgtactaagcaatggagttcctgatacaatgttctgtagaccataataaccagagaaacttacttttgctttacctgctttaccgcgttttgtcgtaatcaatataacaccatttgaagcacgtgttccgtatactgcagccgaagcaccatccttcaacacatctattgtttcaatttcttccgcaggtaaattaggattaccgtcagccggtattccatctacgacataaagaggacttgaattaccattaatagaacccaatccacgaatttgaataacagcgccatctccaggacgaccggaactttcagtaatattcaaacctgaaatcttaccttgcaaagtttttgtaaaatccgaacctgctatttttagcatttcatcagactttatctgcgaaacagcacctgttaattcttttttcttctgtacaccatagccaatagctacaacctcagcaagcataacagattcttcttttaaagaaacattaatttgtgtttttccattaacagagatttcttgtgtttcatagcctatgaaactgaatacgagagtcgacttactatcagcctccaaaaaataattaccatcaaggtcagtaattgtccctgcggtattatcacctttaacagaaactgtagcacctattataggatctttcatttcgtctgtaacttttccactaatagtaatcttttgtgcactaattgcagatacacaaaacagaagcattaccaataaaggtaacctctcccactttttgtttttgatttccataaattgattttttagcaaacaataaattaatttttttgcaaagaaagtgatagttggtgttttatatatattggaaaagagtttttaatatggtgtatttgcatacaatggcattttttttataaaagttctcatctacaatataagcaattatagacatttaattttacaagtgcaaatatacagctgatggtagatcagattgagtttcaccctggatatacacaagtggatacagtactttattgccagagaaataatattacagtaaagcatggagtccgcttggaaacggatatatgctgcagtatcctgttctatgtgaaatagcatcaagatacaataaatcggtggctcagctatgtttgagatgggtactacagaacaacgttgttccactgccaaaatctctgaacaaagaaagaataattcagaatgccgatgtatttaatttcgaacttacatctgaagatatgaatttaataacgaatatggaaacatgcgggttctccggctactacatagacgaaaatatggaataatacgtttaaacataaacttcccctaaaaaattaaaagtattttataggagaagtactcaaataccatacttttttttcaaaaaaccactgattagttttttttaatggtaatacctttgccaataaagaaaaggattgtttgagcaagtggtatacataattaaggtagattgttttcaagagataacaaacagaattatttaatggttgttgcattgcagcaaccatttattatttaattattaacaaatggcgttttatgaaaacatctgaaattctaaaagcaactctcttacttgttccggcaattgcatgggcagaaggaaacaacgaacaaaaaaaaaacaaacattgtgtttattctctcagatgatgccggatatgctgatttcggttttcagggaagcaaacagtttgaaactcccaatcttgacaagctggcggaaaacggaatgatactccaccagatgtataccaccgatgcggtgagcggaccatcaagggcaggacttatgaccggacgctaccagcagagattcggtatcgaagagaacaatgtagtgggatacatgagcaagcacggtaaatacggacttgacatgggtgttcctacttcagaaaagtttatatcaaactatcttagcgaagctggttatgtttgtggagcattcggaaaatggcatctgggagctacagacgaatatcatccttacagaagaggttttgaccaatttgtgggattccgttcgggaggtagaaattattatccttatcagaatgaagaagagtcctttgccgatgagggtgtggaaaacagacttgaatacggattcgctcatttcaaggaaccggataagtatatgacttacctgctcgccgacgaagcctgcaagttcattgaggaaaatgcaaaaaaacctttctttgtttatctggcattcaacgctgtacatgctccgctacaggctgaaaaggaagacctggcgaaatttgctcacctgaaaggtaaaagaaaaagtcttgctgccatggcatgggcaatggacaaggcttgcggacaggtgttcgacaagcttaaagaactgggacttgacaaaaatacaatcatagtgtttactaacgataacggtggacctaacggaactgaaacttccaactatcctctgagcggtatgaaagctaccttccttgagggtggtgtaagagttcctgccataatttcttatcctggtgtgataaagaaaggtagccactacaacaagcctacaagcttcctcgatttcttgcctgctttcatcaatcttgcaggttacgacaaggaaattgcaaatccgctggatggtgtagacattattccctatcttactggcaaaaataacggtcgtcctcaccagactctttactggaaaattgaaaacagaggcgttgtgagagacggcgactggaagttcatgcgtttccctgacagaccagcagaactatacgatataagtaaggatgaaggcgaacagaataatctggccgacaaacatcctgacttgataagaaaatattataagatgttgtcagactgggaaatgacactagacagacctatgtggatgctggaaagaaaatacgaaaagcgcgtgcttgaacagttctatgagcaggaagaatacagacgtcctaaagaatataaataatagacaaataagttataagactgagcgaaggaacggattcttaatgtcaaggctaaacaaacaagtaactttagccttgacacttactttattaaaacaaaagagataagtaagtgatctaaaatatttttatattcaacataaaatattaatattgtatcatgatattttagaatgtaaatcatgaaacatataaaagtgcttgaattaagtgaggctaatcgcctcgaattggagaaaggctatcataatggccctactcataactatcgtatcagatgcaaatccatattgttgaagtcatcaggaaaatcagcttcagaaatagctgaaatattcgatgtgacaataccaacagtatacgcttggataaaacgttataaagaaaatggtatcaaaggcttaaaaacacgtcccggccaaggtcgtaaacctataatggattgttccgatgaggaagcagtccgtaaggctatagaggaagaccgtcagagcgtgtcaaaagcacgcgaagcctgggaaaaggcttccggtaaaaaagccagcgacattaccttcaaacgttttttaggagcattggtgcaagatataagcgaataagaaaacgcccaaggggtaccccctcaccgcaactctattcatacaagaaagagaagttgcaagaacttgaaagccttgattccaaaggttaaatagaactttaacctgttggcggaattaaaatagcgcatatttaactctgccaataggcttttcatttttgtagttaatatattgaaggattgtaagtgcgctaatcttcccaataatccgggcaaacaatccatctgtatctttcgcataattccttataatcataaactggtcacacaattgcgagaatagggtttcaattctttttctcgctttggcaaaagccggaaatgttggcttccattctttttgattacatctgtatggtacctccaatctgatattggcagtttcaaacaaatccaattgcgcttgggcacttatatatcctctgtcccctatgactgtacaattactataatccactttcacatccttcaggtaatgaatgtcatgcacacttgccttagtgaggtcaaaggaatggatgataccacttaacccgcagactgcatggagtttatacccataataatacatgctttgtgatgcgcagtatcctaccccaggtgcttttctaaaatccttctttcccatactgcaacgtttggaacgggcaatacgacatacttctatcggtttcgaatcaatacagaaatagtcttcaccaccatccattttagaaaccattctttctcggattgcattacatagggaggaagttattttacgcctgtcattgtattgtcggcgggaaataaggttgggtatttcaaccctatattcctgtagctttgcaaacaacagcgactcactgtcaataccaacagcctctgatgccatgttcaaagccactacttcaaggtctgagaatttagggacgactcctcgtcttggtacattcccggattcattgactaaattgccggcaatttgcttgcatatgttcagtaattttgcgaatattgcatataagttgtgcatacgatatttgtctattaaaagtttagtcacctttaatttactaaatatcaacaatatgcacaactttttaaacataaatcttttataatttaattccgccaacaggtaactttattatgctgatgaaagtcatgtatgtaccgatggttatgtaccttacgaatggcagttcaaagatgagaatgtatatattccatccgagaaagctgcaagacttaatatctttggaatgattaccagaagaaatcaatataaaggctttacaacacaagaatccatcaatgcagacaggcttgtggattatcttgacaggttctcttttgaggtaaagaagaaaacggtggttgtacttgataatgcttctgtccataggaaccgaaagataaaggaaataagaaagatatgggaggatagaggattattccttttctatcttccaccatactctccggaacttaatccagccgagacactatggcgtatattgaaaggcaaatggataagacctgctgattacaatactaaggactcgcttttctattgtacaaacagagctcttgcatctgtagggacgaacttatttgtgaattactcatatgtataaaattaattttgaatagttacttatgaaaaaattttgtttattcttttgcataatatttacttgtataattaaggttttcccgcaatatgtaataaatggcgaagagtatgaattccgtaccaggaatttgcctcaaagtgaagtcaatgatctaattcaggataagtatggttttatctggatagcaacacttgatggtctgtacagatatgacggttatgaatataaggcatatttgagtgacgggcaggaaggggctataagtacaaatatgattctgagtctggatattgacagctataataatctgtgggttggtacttatggacgcggattgtcacgttttgactacgaaacaggtgaatttataaattttcccattgagatacttataaacagaaaagatttaaaggggggggacattacagcggtaatggttgactcgcagaatgatatatggataggaatgaattatggtttgttaaagattaaattcgaccataaggaaaatattataacagaaagacatttttttgagttcgagggaaatgcttccagtgacgcaataaaggatatatatcaggatgtatatggtaatatttggattgctaggaatgcatatactgaactggtgacaggtataaaggacgataagctggtttcaaataaaatttacatctcaggcaatatcataactggtgataagagtgctattcttgtaggtggatctaaactgtttaaaatagaacctcatgacggtacttttgataacattactcctgtcctgctatacgataaacctgtatctgcactaataaaagattttgataatatttgggtggcaaatagaaggggtttggaatatctttcccaatcagaggataatgaaaattattcaactcaattcagtcttaataaggagtttgtcaaatctttgaatagcaataatgtgtcatgcttgatgactgactctgaaaacaatatatggattggaatcagaggtggaggactatactcactaaacaagaaagcacataagtttcagaattatatacccaaaggttttcataaagatccttccggtagaaaacagaagagtgaatgtatgcaggttcgtgcggtttttgaggactccgacggtaatttgtggttaggtgaagaagaagaaggggtgttcaggctctctgcagataaaaattataatgatttgtttcaagttgtaaatgtcaattcaaaatatgagaatagaggttatgcttttgaagaaacaaaactcaaaaatggtcgtaaactgatatgggtaggaacaagttttccggcaaatcttgttgcaatagataacaaaactgccgatattgtaaattactcttgtccttcatcacttaaaatgggcttcgtgttctcaatagaaaaaacttcggaaaatgttttgtggattgccacttacagtaatggagttttcagattacagcttgataacaatggaaatgttgtggattacagacatttcactatatataattctgatttatcttcgaatataatccgttctttgtattttgataataaatctaaaatatggataggtactgacagtggattgaattttattgatatcaatgatgaaaatctgaaagtaaaccgtataacattcagtggggatagtgactggttcaatcatctttatgttcttgatataaaggaatataatggaaaactgctgatgggctcaatgggtaatggattaatattatacgactatattaataacagttgcacaaaactgactacaaagaacgggctgcacaataattccattaaaactgtgctgacagatcaggataataatgtatgggtatcgagcaacaaaggtatttccagagtcaatctaacagataacagcattatccattatggaaaagataatggcatatccgaagaagaattcagtgaaatatgtggtgttaaacgtcataacggtgaacttgtatttggaagcagaaggggaattcttgtgttcaggggtaatgaaatagtgaaaaatgagagaaagccaaaagtctttataacagacatgctgactaatggtacatcattaaaatttaattccgagcacagtgagctggtactggattatgatgacaggaatgtagcgttcagatttaccggactacagttgtccaatccaggaggattaaagtattactataagcttgaaggttttgacaacgaatggcagctaactaacagtactcagagaactgcaagatacaccaacttgcctgagggcgattatatatttattgtaaaagccagtaatgaagatggttttgttagcgaacatccagcccaattgagtttcaccgtaaagccaccatttgtacgtagcggactggcatactttatttatttcttactgtttgtcgtccttatgtatatatcttatttgatattaaaagctttctatagaaagaaaaaagaagtacttgcagcaaatcttgaggctaagcaggctgaagaaattacacaatacaagcttcagttctttacggacgtgtcgcatgagttcaggacacctctcactctcattgagatacctttggagtcggcaatcaataattgtggatctgacaagaaacaactttattatttgaccctcatacgccaaaatgtttccacattgaaaattcttataaatcagttgttggatttcagaaaaatagaacgtgggaagctacagtttaatccgtatccggttaatgtgtcagatgtggttggagatatttattcgaggtttaagtgtctctcagagagcaggaatataatatattctataaatactcctgaagaagctgcagtttcgatgatagatatttctttatttgagaaagtaattgcaaatgtaatttcaaatgcattcaaatataccccacaaggaggaagtataagtgtatatgtagcgaatgatgccaataccataacagtgtctgtacaggacacaggtgaaggtatttctgaggaagaactgtcgcatctgtttgagagattctatcaaggcaaggagcataataaactcaagcaggctggtacgggtatcggtctgtctatgtgtaagaatattattgatgttcatggaggaaatatcgaaattttcagtaaatcgggtgaaggaacaaaatgtaatattatactgaagagagaacttacagaacatgtgacattgagtgagattccatattatgatatattaaggaaagacactctatcgcttattgacgacgaattatcgtctatggatttttcgaataatgaagttaaacaggagactaaccagtcggaggattcagaacttcataaactgactttactgattgtagaggataatgaccagatgagaaatgtggttgccgagaatctttcttccgattttgaagtcattactgctggaaacggaaaggaaggtcttgaaaaatgtaaggagttttatcctaatctgataattacagatatacgcatgccgataatgaatggtattgacatgtgtattgagataaagaaagatgaggagataagccatattccgattatagtactaacagctaataattctgtcaagaacagactggacagttataatctggctaatgttgattcatatcttgaaaaaccttttgaaatgtccactttgcgtggggtaataaaaagtatattggccaatagagccagattgcaggagcaatactcaaaaaatgctattatatctcctgaaaaggttgccagtacaaagactgacctcaattttatgaccgagattattaatattattaaaagggaaatgagtaatccggagttaagtgtagaactgattgccgatgagtatggtgtttcgcgaacatatttaaacaggaaaatcaaggctattacaggagacacaactttgaaatttatacgtaatataagattcaaatatgcggctcagttacttcagtctggcgagaagaatgtctccgagactgcgtgggagattggttataatgatgtcaatactttcagacttaggtttaaggaaatgtttggtgtaactcctacatcatatttaaaaggaaaatcagaggatgagagaccgtaattcaaactgtgtcaatcctaaacaagcctgattatctcaaattttactttcggataaacacctgaaaatcagatgtattcgaagtaatatttaactaaataaatgacaagttaaagggttgacacagctctatttacgtagcctacgtagcctctatttctaaataaaatcttataataccctgaaatattagttctttaaagcattgtcaataatagcttttattttaggatatttttcgtcagtatcgccaactttttctctaagtttagccagacgcactttcatatctttcagaacatctttatattcgggatcatttgctacgtttttcatttccataggatcctttttcaagtcatagagttcgaaagcaaccggagtttgtaccaccttatgactgcctttatctcttaaccaccacattgaaggagtgcccattgtcttttcgtcataatgtcttccgtagaacaatatcagtttataatcttttgttcttataccaatatgtgcaggaatatcatggtgaatcatgtgcatccagtatctgtagtaaacctcatctttccagtttgcaggagttttaccttcaaatacatcagcaaagctttttccgtccatatattctggagccttaccgcctgccagttcaatcagagtaggagcaaagtctatattatttatcattaaatcgttatgtacacctctttgcttagattttggatctctcacaataaaaggcattctcattgattcatcatacatccatcttttgtcctgcaagtcatgttcaccaagcatcataccctgatcccctgtataaacaataatggtattttcccaaagtccctcttttttcaggtagtcaaacagccttttcaagttgtcgtccacaccttttacacatctcagataatctttcaggtatctttggtacgcttcgtatgtatcctttttaggatcacctgtatttattttatagtcttctgcgtagcttctgttctcatgtcttcttgaaatagaagtaccgatgaagtgtctcagagagtcatttttccctcttgtagcctcagaaccccatccatcctgattataaagcgattccggtaccggaacttctgtatcttcgagataatatttatatcgtggagcatactcaaacatgtcgtgaggagctttatagtgatgcatcaggaagaaaggtttgttcttgtcacgtctgtttttcagccagtcaatagttatatttgtaataacatccgaagaatatccatttgtctttacctgatttttaggccattctttgttacttatttcatttgtaagaaatgtgggattaaaatattcaccctgtcctccatgaccgttaagaactttgtaataatcaaagtttgcaggttcgtttttcagatgccatttacccaccatggcagtctgatatcccattttgctgaattccttcacaagatattgtctgtctacatcaagtttttcgtcaagtgtaagaacttcgttatggtgagagtattgtccggtcattatgcatgcacggctaggagtgctgatagagttcgtacagaaacaattatcgaatactactccgtcactggccagttcatcaatattaggagtaggattaagttttgccagatggcttccgtaagctccaatagcttgcgaagtgtggtcatctgacatgatgaatatcacgttcatcggtttttcctgagccatactgcacacagtgggtacaactgcaataactgttgccaagctgctgttaaaattaaattttaccatggtatgttaattttttattttatgataaacttgtttttctgttgtaataccctaaatatgtatcgttcatatttcgttatatttaaaggcttataaagttttcaaaatatatgaatctgtctgataagccttatttatatctgtttcattttccggtaacaggtatgctactatataatacactttatctttttcatattctacactatattcaagattgaagctggcatatcctgcaaagagtttcctcgaatttctacaaatttcttttttgtctttattatatattattactaccgcattacaattatagtcggctgtatatatcagttccgtgctatatttgttttctttatttttgagtattctattctccttattagttatatttatgttattgccaaacactttattttggctttcttcagtttctacatttatatctataagagtataagccctaacccagtcataatatgttttattcattgtttcatcagcaagttcctcatcgctagggagctctatccatggatatgggtatgtttccactaccatgtttacgcccataggttcagtaaaataaaatggatcgttagtgtctctattatagaattccacacttcctgattgagtgttgtttagatagaaagtggctgaacttttgtctttccaccaacaaccatacacattgaaatcgtccgatggtacacctccatcctctctgtatagccttgtttctttagctctgatgtctttctgtacattttctccctctggagtaaaccaataatgaacatttgagttcattcctttataaaagaaatttccgttgaaatcaccagtcctgcctatacattcacaaatgtcaagttcttgtttaaacattcccggtgcagctccttcaggttgttttccgtcggtaggaaattttccacttctgtttgaaagccaaaacgttgatgagagtgtcgttttatttgctttgaatctgcattcataatagccatagtgagccttttcttctttagatactacagctgcacatgaaatgttgaattcagtaccattaacaactatcggattgttcatttttataccctcaagtaccatacatccgtctttaaatgaaactctttcctcttcaaatagaccgggttcacgacctttccatgtagggtgtggatttatccattttgactcatccaattcactggcattgaaatcatcagtaaacatatcatttacaatccatctttgcccagtagggggtaaagggattgtttttattttttcacttacagggaaagtattttcgggaaattcttctgtattattattgtctgcaccttcctgattattgacagattcttcttgacctgtttctataataacttcattgcagtttgcgaatgttattgcacacaatattaatatgtttgtaaggctaattctttttttcataattaccaatttaaatttacaacagtagcagaactaaatctgctgccgttgtaaatgattataaaaagtattactttgcttggtttttcatttataataaatttatacgaaaatagcttgtcgaatatcttatttgtgatattgtcgtggtttacttaaactcacgtaatttttaatacaaagcaaatttataacttccgaattgatggaatagtaggtgttttgaaattaaagagtgggtattttcgttttttcagatagaatcttggttttcaaggtatccagattgtacaaatagtcagatgcttgttggtaattaaagcacctgaccataaaaatgatgtttttagttcttataaacaatattattgtctgctttcagaacatatttttttgttttctcagtgtcaatattatgtatgaaggtttcttctgttaatgcagcactattcagtgtaacagttctggttttactgtcattacccgcagtgcttaccaaatccacttctacagttttatcaccatggttcatgattcttatagtagacactagtttgtcaactgttttgtctgtaactggttttgctatcacagtaccattgagttcaattctaagaacatgggcatattctgtaggtttctgtttcgggaatttcactttcagacctatatctgtaagtttgaattcaagcttttcttctgatccgagcatacttacagattttatctccacattctctatataatcttttgcaaacgatttgataagaacttcatcatcccatgcaagtgatattgcatatactttattatcacgagttgtaaaacgaatgtcttgagctgtgtattcggttttttcattatctgtcatataaccggcagttcccttgttttctccttcgcctggagtaacccatggacgagagcaatagattgcttcaccattaactttaagccattttcctatctctttaagaacattcttttgttcgtctgtaatagttccgtcaacttttggtcctacgttaagcaataggttaccattcttgctgactatatccacaaagtcatcgataatatggtctggagttttgttctcctcatcaggacagtagctccatgattttttacctattgatgtatcggtttgccatgagtgtttacgtattctgtcacttttaccacgttcgatatcgaatacctggatattatcaccatagccgaatttggtatttacaacaacttccttaccccagtcaagcgcattattgtaataataggccatgaatttatagaaagtaggctggaacggatattttcctacagtccagtcaaaccatatcagttcaggctgatattggtcaatcagttcgtaggtatgcaagaggaattcacgtcttgacttttcgttagaaccttcatatttaccgtagtaaggagtcatacctttaccttcaggctggtgcagacgttcgccgtaaagagaaatactcatatcctgaacatcggatggtgtgtccattccatattcataaaaccaagcattctcgcatctgtgcgatgataacccgaaatgaagtccttctgctatgattgccttttttagttcgccaataacatccctcttaggacccatatctaccgagttccacttattgaaggtactattgtacatagcaaaaccatcgtgatgttcggctacaggtaccacatactgcgctcctgattccttgaaaagctctgcccattcctgtggattgaagttctcggctttaaacataggaataaaatctttgtagccaaattctgtcagtggaccatacgtttctacatgatacttgttaataggatgtccttctttatacatccatcttgaataccattcgctgccgtaggcaggcacagaataaacaccccaatgaatgaatataccgaacttggcatcttcaaaccatttcggtattctgtagttttgtgcaattgatgcagaatccggtttgaatatgtcagtaccaattggagaagctgtagtctcaatgttgggcttgtattccgaattgttacatgcgcttaagcaggcaatagttgcaactgctaatgaagtaatgattgctttcatttttatagtttttataagtttaaagttctacatttattgttgtcttagctgttttaagtcctttagaagtggcggtwatattyntttttycttkyttkttttynntcmgactgaamaawtarcatacacataccsctgratgcttttnnttttkggttytatgaacgactccgttgttgcagcattaccgtttcctacagctctaaagtgtcctgcaccttcaacactgaattctaccagattgtctgcctcagggcatagattaccgtctctgtcttcaattcttacagtaatatatgacagatctttgccatcggcagttattacctttctgtctggtataagtttgatttgagctggtttacctgctgttctgattgttttttctgcctttagttcacctaaattattgtatgcctttactgtaagttcacccggttcaaacggaacatcccacgagagacgatattttgactggaatgtgttaggggcataatgattaaacgacaccataatttcagttaggtctcttccttttacccttttgcccaatgattttccgttaagaaaaagttctgcctcataacagttggtgtaaacatatacaggtatgttcattccttttttccagttccaatgaggaagtatatgaaccatcggtttatctgtccattggctttgatataggtaaaatctgtctttaggcaaaccgcacaaatccactgctccaaagtatgatgatcttgaaggccagtcgtcattccagtatccatgggttgaattatctctgcctccgtatggtgtcggttcgcccagatagtcaaatcctgtccatataaattcccccataaagcgtgggttcatttcctggaaatggaactctatatcaggtgggtatgcccatttgggaccgataaggtcgtagcttgtaacctgatttgtgccgtttttctcatatttctctataggtaggtgataaactccacggctacttgtacacgaggaagcttccgagccatataatggaagatcaggatatagtctttgaacttcagcatatttgcctggtttgtaattcattccagcaatgtctacctgctgtgccatgttgttgtcgaatggggcagggtaatagttgaacccacatgtacttggacgtgtaggatcaagttcgcgacaaatatctgcaagatattttgctactgtaaatccttttttcttatcactttgctcaagaatttcattccctatactccacattattaccgacggatggtttctgtcgcgcattatgaggcttgtaaggtcttttttactccactcatcaaaatacaggtgataaccgttgtctactttagcctttgtccattcgtcgaaggcttcatcaagcactacaagtcccattctgtcgcacaaatcaagaaattccggtgaaggagggttgtgtgatgtacgaatagcattcacacccatttccttcataatctgaagctttctttcatctgctctaacgttgactgcagctcccattggaccgttatcgtgatgaagacatactccgttaaatcttattttttcaccgtttaggaaaaatccgtctttcgtaaaacatattttacggataccaaagtcggtaaaatatgtatctgtaaggtcttttccatcatatatttctgtcttcagcttatacatatatggatttttctgtccccagatattaggattcaacatatttatatatgcaagagtttttccctgctccccggcagctacttcaacattatcatttaatattgctaccgtttccccctgagcgttgataatgctatgcctgatattaaatttcccattgccgaatgttgcgtttttcacagttgtttctatctgtactacagcttttggcttagtgacagtaggagttgttacatatactccgtgttcgggtatgtaaaccttgttgtctactcttaaccatacatttctatagatacccgcaccgggataccatcttgatgacagatctcgcggagtaagctgtacagccaatacgttttcttcacctatttttagatactttgttatgtctatctcaaacccggtgtatccgtaaggatgttcgcccaccttaactccgtttatccaaaccttagcttcgctcattgctccgtcgaagccaattcttacaattttgtccttccattgtgcatccccaatgaaggtctttctgtmccagccagtaccatgaaatggcagtccgccgcatcttgcattgtacttgctgtcaaacggaccttctattgcccagtcatgaggtaagttaagttttctccacgaatcatcatcgaacgatatagcttcggctccttttatttcacctttaaagaagcgccagttttcgttgaaggagataccatccgttactgcgtttattgtgttacccagaatgagcaacaggataattgtacctagaagtcttttcattatatttttcgttttaataaattttctcagcaaagttattttccatattgatatatctgactgctcttgtgtctccatcctcacacaagcctttatttccgtcagttgaataggttgaactatagtacctttttcccatcaggtctacaacataagaaagcttcatgttgtcattgctgctttttataatctcatcagtcaccagtttcttcattgtcgccatatctgatatatgaaccagtgaataatctccggaaactaccgcatcatgcaaaagtttcctgttctttttgaagctcaacagaatcttgttctttctgctttttactccattcccatgttttactaatccgaataattccttgaattcttcgtagttattgaaattatagtatagcatatcattctgaagcaattttattaaagactgctactttatcaaatctgctcgtttttattatcttaatttaaaaatataatgatcaatctatcgaattatctttgtacacgtccgcttgcatcaccaccagccaaagcttcaacttcttcaatagataccaagttgaaatctccattgattgtatgttttaaagccgaagctgcaactgcaaactccaaggcctcactctgagttgctttagtaagcaagccatggataataccaccagaaaaagaatctccaccacctacacggtcaataatcggattaatgtcgtatcgttttgatgtatagaattcttcaccattgtaaatcatagctttccatccgttatgtgtagcagagaatgattcacgcaaagtagagattacatatttgaatccgaactctttggccattgcagtaaaaatacctttgtatccttctgcatctgttttgcctccttctatatcggcatcaggcttgaatcctaaacaaagttctgcatcttcttcatttccaatacatacatcaacatattgcatcaatggacgcataatggactgagccttttctttagtccaaagtttcttgcggaaattaaggtctactgagactgtaacaccatgacgcttagcagcctcacaagcaagtttagtcaactcggcagctttatcagaaatggctggggtaataccagaccaatgaaaccagtctgctccttccataatagcatcaaagtcaaagtcacatggttctgcctcagagattgcagagtttgcacggtcgtatataactttacttggacgcatagaggccccagtttcaagataatatatacctatacgatcaccaccacgagctatatagtcggttctaacaccatatttacgaagtgcatttactgcagattgccctatttcatgcttagggagcttagaaacgaaataagtttcatgtccgtaatttgagcaacttacagctacatttgcttcaccgccgccataaacaacatcaaaggaatctgattgaacaaaacgtgtattgcctggtgtagacaatctaagcattatttctccaaaagttacaattttcatcgtctattatttttaatattaataaataaagttaatttattgtcagaatgaattacttgctatttcacatttaccgcattacccattgcaatgagaaccactcccagcaacatagcaacaagagcaaaatacaataatcccttcgcttttttaggagcatcagcccactctttagtaagaagtccgcctatcaccgccagaaggacagatactgtattataaatggcataaccaactgtattgcctgccgaacctaaagaaaaagcagcgtacgcaaaagatgcagaagcagtataattcaaaaatgccattacaaatgccatccagaaattagacaaacagtattcattcttaaacagaccccacgtcttattcttacacaatttaattacaaaataaggaatagcataaagagctccggaaagatatataatgaacattattgctatagcactcatccattcgggatttccctgtgttacaacagcctctgtaataggagcattacctacagcgtttgccagactgaaacctgtagctaaaagaccacctataagagctatgaatattcctcgcaaagtcttgccagacgaaagttgttccattgaatctttatgttccgaactttcttttcgaagtataccggcacgcccgtttgatactactcctataagaatgattataagacctattattatataccataaagcattttcagaaggcaatccgtcgacaatgaatggcaaaatagaacctaccaatattacagaacctataaatattgagaaacccaatgaaactcctatataatctattgccttgctccatagctgcactcccattccccaaagaaaagatgtcagtaccatgagataaagtacattcgaaggcaatgatgcgagaacatcacaaaaattgtctatcaataaaaatgaagacaccaaaggcattactatcaatgccaggaaaaaaaacagaaaccaggtattctcatatttataacctttaatatatttctcaggcaaagcatacaagcccaacataattccggctcctacagcccataatattccatttatcataatcttattctgttaaaaattaaatttaaatattgtatgactctcaaatttctcacccctgtcggtaaaaaccttatttgcatcttttaaattaggaccattaggtactctatgtgtctcacaacaaaaggcacagtacttaccatatttctcactttcatttctttgtaatgaagacgaagtatatttggctgtatacaggagcattccttcttctgtcgtcagaacttccatacttacattactagaagggcaattaatctcggcaaccttctccggaacatcagtaaatcccttatcaaacatatagaagtgctcaaaaccatcatttatctcattatgaacctgacctatattccttgaactacgaaggtcgacgctgctgccagatatgtaaataatattcttttctacactgcctgaaggattcattggcaatacattacttgctgcaacatatgcattatggccttctacattctccataaatcccgaaagattgaaatatgtatggttagtcatggatagtggtgtacgcttatctgtatccgcttcatatctgaaacttaattcgttattattattaagagcaatgataacaaccgctgttacattaccagggaacccctgttcaccatcgggagagaaatacttcaatgttatagagctttcattttcaaagctatcgcatccgataacaccccatacttttttatcaaaaccctgcacacctccatgaaggcaatgggtattgtttacatttgctgaaagtttcacgtcatcataggacgcattttgaatggtggcgcaataacggccaattgtagctccgaaataaggtgcattagaaagaaactcatcggaaaaatagccttcgagggtgtcaaaaccacaaactatattccttttatttccattaccaacaggcaataagacagacgtaacagttgctccataattcattacagagacttctacaccattatcattaacaagtgtatataatgtgatttccattccttcgacggagccaaatctctcttttcgtattttcatatatcatagttttaaagttattaagttatattcttttgataacaccaatgaggttatatcaaatataatgtttgatatagcctcattgagaaaagaagatattaaagcttcttgtatggttcaagcatttcccagttgaactctactccaatacccggttcatctgacgctatagccatacaatcctgaactaccagcggacgacgcgtataacggtctatcggaaaactatggacttctatccaaccggcatgtctctgtgatgatacaagacttacatgcagttcctgcattccatgcgaacatacagttacgttgtgttcttcagcaagtttggctgcttgaagccatcctgttatacctccacagtttgatgcatcaggctgaacatatttcagtttggactgttccatagcatattcaaactcgtgtatggtgtgaagattctcacccatggcaagaggcatgcctgttgcatcagtgatttgagcgtagcctttatagttgtcaggaattgtaggctcttcaaaccaggttatatcgtattgcttgatacggtttgccatatcaattgcctgctctactgtcatggaataatttgcatcaaccataaatgtaatgtcaggtccgataaactctcttacagccttgattctttcaacatcttcatcaggattttcgcgaccaatctttattttaacaccattgaaacctgctttcagatagccatcgatattcttcagaagtttgtccaaagggaacagaaggtctattcctccacaatatgccttacatttgtttgaagctccaccagccatcttccataatggctgaccggcatgcttacatcttaaatcccataaagctatatcaactgcagaaattgcgaatgaagcaataccacctctaccaacataatgaatatgccattgcatcatgtcgtaaagctcttctatattgtctgcatcctttcctataagtgcaggaatcaggtcattgtcaatcatggccttgattgaatagcctcctttaccaccggtataggtataaccagtgccttcacttccgtcttctaattttattgtcgctgttattagctcaaaatagaaatgatttccatgctttgcatcggcaagtacctcatccaatggtacttgaaacaattgcgttttaacagacttaataatatgtgacatcttattattctttataacggatatagaatgttttcttctcaagatactgttcgaaaccatacttgccatcttcaccggcagctccactcagcttgtagccattgtggaatccctgatgcaattcaccatgaggacggtttacgtaaatttctccgaactcaagatcggtatttaacttcatgacacggttaagatcattagtaaataccatagcggccaaaccgtattcgcaatcgttagcataattgattacttcatcatagtcggagaatttcagaacagggagtataggtccgaaagactcttcgtgtacgattgtcatattttgtttcacatcagtaagaactgtaggttcaaaccagttacctttctggaattgctcaccttcaggaactttacctccacatgccagtgtcgctccttctttcaaactgatttctacaagctgtttcatgtgttcaagctcattcttgttgacctttggtcccatatcagatgttggatcgaatgggtcgccaaccttaatcgctttaactttttccatgaatttagccataaattcatcatatatcgactcgtgaagatacaggcgttcattacatgtacaaacctgaccacaattatcaaaacgagaagaaagtgccgcatcaacagccgcatcaatatcagcatcatcgaatacgatgaaaggtgcctttcctcccaactccaactgaacatggataatattcttagccgcagaacggtaaatggcctgacctgccggagtactaccagtcatagtgaccattttggtaataggattttcaaccaaagctgtacccataactctacctgaaccggtaataatattgagaacgccatcaggaacaccagcctttttggccatctcacccaacatcaatgttgcaataggggtttcagtagtaggttttacaacaattgtattaccagctacaagagcaggacctatctttctgcctgccaaagccaatgggaaattccatgctgtaattgccactaccacaccacgcggaattttctgaatcataagatgttcattaggattatctgaagggacaatatcgccttctatccttcttgcccattcacatgcatatgcaataaaagaacaacaaacatcaacttcaaactgagcaaccttgaacagttttccttgctctgtagaaatcattctggcaagttcttccttatttttctttatttcttcaataaaggcataaagtatttcggctcttcttctggctgttagttttgcccatgatttctgagctgcctgtgctgcctgtaaagcaagatcggcatctttctcatcaccgtttgcaaccattccgacaactgagtcgtccgaaggattataaacttcagtatattttccatttaatggtgcgacccacgcaccattaatatattgctgatatgtcttcataagtatttcaaaaaatagtatttataacaatattatctacccatccagccaccgtcaaccagcatgattgttccatgcatataagcagaagcttctgagcaaaggaataccaccggaccaccgaaatcttcaggagtaccccaacgtccggcaggtatacgagtaagaatctgctcagaacgtactgaatctgcacgcaaagcagctgtattgtcggtagcaatataaccaggagcaatagcgtttacatttacacctttaccagcccattcattagcaaaagccatagtcaactgaccaacagcacctttacttgcagcataacccggtacatttatacctccctggaaggtcaacaaagaagctgtaaatacaattttaccattgcctcttgccaccatatcctttccgatttcacgtgtcagaataaactgagctgtttcatttgtagcaataaccttatcccacatctcgtcagggtgttcggctgccggtttgcgcaatatagtacctgcattattaatcaaaatatcaattacagggaaatcagccttaactttattgataaaatcatacaatgcgtctctgtcgctaaagtcacaagtgtatcctttaaagttacgacccaaagccttaacttctttttcaacttcgctaccttttggctccaatgaagcactaacaccgataatatcagcacctgcagcagccaaagctactgccatacctttacctattcctcttttacaacctgttacaagagctgtcttgcccttcaaactgaatttatttaaaaagtccatattattatttagtttaaaatcattaataatgtaatttgtcacttgttaatttattatttacccttggcagtctaccaaatatttcattccactaggattgcttacgatttcttcgaataatgactgtatatttgtcaaaggctgaacattagagatgatgttttccaacggaagaactttctgattaaccaaatcaatagctttttcataatcttcatattcataaacacgagctcccatgaatgtaagttcacgccagaacatcatcttcaagtctacaggtcttggttgagcatgtatagcaacacctactatacgggcacgcaaaccggcaatttctgtcatagcgttaaccgtactctgaacaccggcaacctcaaagacgacatcagccaaagaaccgttgcttattttcttgacatattccaacaggtcttgttcagctggactgattacatcaaatcccatctctttaagaagctttattcttacaggattaacttcagaaacaacaatctttgcacctgttgtttttgctaccattgccaccaaagctccgattggaccaccccctaaaactacggcaacttcaccggctttcaatccgctacgacgaacatcatgacaagctacagccaaaggttcaattaaggctgcaagtttcaggtcgatatcatccggaagtttgtgtaaagtgaacgccataatgttccaatactgctgcaacgcaccttcgctatcaataccaataaatttaagttttttacagatatggctccaacctttatcagaagcatcttcaagacgattatcgagagggcgaacaactactttatcacctactttatatccttctacaccttcccctatagcatcaattactcctgacatttcgtgaccgatagtctgcgggatagaaacacggctatccatattaccatgaaagatgtgaacatcacttccacatataccacaataagcgaccttaattctaacttcgcctttagcaggtgcaattaattccttttcttttacagtgaaggttttatttccttcataataacttgctttcatttctttataatttaaaacatttaactatttagcttttccaaaacctttggctacaggaacttcaatttcactattataattctgtccatctgtctgaatcatggcaggataatatcggtaataatttccgttagtatatttgtgcaatgacttggacatctttttattcatttcattaaactgtttagtagcttcagcctgatcgccaatcaagaagaaatatttatttgttgagatttctttaccgcccttgtctgtcagtgtgagttcaacatggaacatcttcttaactgtagacagaacattataactgatatcagtgagtttaaatgcacaattctcgcctatcttacttaccttgtagtcagcctctttaagaacattacccacatcgtcttttatacggatagtaacatttgagttcttatattctttataaaggtcgttaactatccatattgcacctttgaagctttcatcattatgccatctgcgccttgtgaaatcaagacatacaagcaatggctgataggctctcttaacaaaatcgtacgatctcttaggctgttggtaggcatctacaataccccacttcatgtcaggccagtaagttatccaatgacaaagggctattccgctaagtcttggtttctgacgtcggaagaactctacaccattctggaatattacaccttgagcatcctgagtagcatctacaaactcctgcaatgtcccattggaacgttcttcaccgaatgtatcgaagttttgcatcttaagcttatccaaatcagcccaatgatgtccccagctcaatccgggaggccacatctcagcttcaggaatgaatttcttgagactctctacattgggtacggaggttatggcaaactccggtacgatagggtaatcctgctttctgtaccaatcctccatcagccatcggcccattgaatagaaatacgccaatgcatgggttgcctccttaggtttataaccggcctcttgcgaagcggcacatgttagaggagaatcggggacataaggcaatggaagataatgctgaagggtatcacccaattgcaacagaaagtcattggcaaacttaacatctctggttctcaagaaatattcctcgcctccttccatcattatgagcgatggatgattacgacgttctattgctacactcttggctacctgcaatactttctctacataggatttttccattggaatattaccggaacccaatggcaacatatcctgccataccgttagacctaatgaatcgcatatctcataaaattcaggtatttcaggattatgccagccaaatattctgatattattcaaattggcttccttggccaaaacaagaagtttctcgtatgttccgggagctgtacgacccacaaatatatttggtgtgcctccccagcatgctgaacggataaaaacaggtttaccatttataactgttgtacgtggaaaacttacatcaacacccttcttaaaacctggattccatgccgaggttacctctctgataccaaacttaacctccttataatcgtgtctcacacttccgttttgagcggaaactctggctatgtacagattctgcttacccatatcccatggccaccacaattcaggtttgccaacatggaaattcttcttatacatatgtttgccgggaggtactgtctgtttgaacttgaccagaataggtttcgactcaaaattatatccctgcacagaagctgttatatccatcgacattggttcgcttgaagtattttcaagcattatctccatatccacatcagcactagagttcttgtctatcctggtacgggcataaacatcgtctatcctaaccttaccggatgtcacaagtctcacaggacgccaaattccgaatggaatcaggtctcgccaatagtcgccgaaccatggagtcttcaaaccgccaagttctgtattgatatgagtaggaggattaagcttgacagtaagcatattagcaccgcggcgcgcatccttacctattcttaagtagtctgttacttcaaaattgaatttctcgaacgctccgtcatgccttcccaaataatgtccgttgagccagacatcgcagctatagtcaacaccgtcgaattcaagacggatatacttgttctttacatcctctgtaacataaaactgtgctgcataccaccattcatagtgctgaacccactgtgctttaactgagttcctgccaaaataaggatcgtctatggctccggctttccacaaatcagtgtaaacatcgccgggaactttagcaggattccaaaccaatgtctcaatatcctcagggaaaattttatggattccctgcttttcaccttcaccaggacgcatcatcttcattttccaattataaccgctcaagtctttaacaagctggttgttcattgaaaatgattcgaagcccggctgcgcatttgaatatgcaataccaagcataatcaaaagcgcagacaagatatttctcttcataagctattattttcgctttgttgattcaccaattgcagtatgagtctgtttagtccatgtttcaaaacgcataatgcattgataattataggtaatgtattgatgagtcaatccccaacgcaatatttcagtaggttccttatcattatcagcacttctgttcagaccaatagcatgaggtgctcctggtataacggacattatctcgaagtttatgccgtctggcgaccactgcaaggtattcttttccggtccgtctgttgtaatcaaagatgttatacctcctttataaggccatacacatatctcgtgtccactattgcttataggattatactctgatttggtataaggaccaagtggattatcggctatagctacaccatgtttgatttctctacctccccaggtaatttcctcacccattctttcacctttataataaagatagaatttaccattgtatggtatgatacatggatcatgcactttatgactgtcaaagtcacctttagcttttactttaaatctattatcctcttctccttcccaaacgccattgtcggatggggtaagaaccggcttatcagtcttttcccacggaccatcaggagaatcagcccatgccatagcaacattttccttaactctaactgtgtatggcgatttaacagtctggtaacaaagataatacttaccattccactgcataacttcaggagtgaaaaccgatctgtcatcgtatgctcctttttcacctcttttaacagccacaccttcttctttccaggtaataccatccttacttgtggcataccatatatcgcatctgtcccatggaaaaaccttttcattttcaacatccccggcaaatccctgagtttcaccataactttttgaataccatacatagtacttgtctccaaccttaatcatagcacttgggtcgcgtctaactataccttcctcataagccaaatcaccttttaaaggcatcatcttatattcaaagaaccacgaattgtcacgctgcggccattccatggcacgtttcatcgcagcacttaatttatttcctttgggtattcccaaagaatccgctttacgctggtcataagcactatcatcagtagacactgtagcagaaggctggtttacacaggaggcaaacaacgctatacctcccactattgttaatacattcttcagtaacataattattataattaaatcatttaacttcaacctttaaatcatttgaactaatgctgccagaatttgcattgatgttcagaatgccggccttgtccgtagcctgcaacactagcaatgctcttcctttataggtttttactgtatttgatttatagtttaaaacattcagatgatcgccattttccacacccaataatctgtaattgccaccaatattaaatgttatttccttttcttcccaagaaatatttcttccgttcctatcaatcaattgtgcagtaacatgtatcacatccgtattattagcatcaactgcaaccttatcaactgatagcttaattgaatttgtttctttggtggtataaattgcagaagttgttttcttaccgttctttttacctttagcaactatatttccatctttaaaatctaccgaccacttatagatatgatcctcaaaatctttcaggaagcgttttcctaaggatttgccattctggaatagttctatctcatcgcagtttgaatatatctccacaacaactttttcacctttagtataattccaatgactgtttacatcctcccaaacccaaagtcgttgagtccaaggctttttaggatccttatcagtaaactttccatccttttcaacataagaagacttgttggctgtctgagaatagatagcaataaatggcgcatcagtccaaagtgatttcatcatatggaaagaaggtttttcaaatcctgccaaatcaagcagtccacatccgatagctctttgtggccattctctaccttttgttccaacttctcctaaataatctacacctgtccatataaacataccagggatatagtcacgttcgataaccgctttccattcatgccactgaccgagattttcagtacccattgcaggtttgtcaggataattcttgtgggcataatcatacattactcttctatagctgaatccggctacatcaagagcatcaatatatcctgtctcataacttatagaaggaagtatacaattagctgttaccggacgagttgtgtccatctcacgagtccatgctgccagtttcttcgctgtgcgaccaatatcataagtctgcttaggctgtttagcccactcttccctgattctctgagttgaataaggaggctggttccagaaatatccaccaccggcatctgcactaaagaaacctgttgactccttacatcctttataagtccattctatttcattaccaatactccactgaaatatacatgggtgatttctacttctaagcattacattcttaaggtctcgttcggcccattcctgaaaatattcgcagtatcctcttgttatataatcaatggactgttcatccatgtttaatcgcttatcttttggataatcccattcatcaaaaaattcttcctgaacaagaaatcccatttcatcacaaagctccaggaaagcatctgcaccaggattatgtgacaaacgaatggcattacaaccaccatcttttaaagtctgtaatcgtcttctccaaacatcttcaaccaatgcagctccaatcatacttgcatcatgatgaagacaaacacctttaatcttcatgttctttccgttgaggaaaaatccttttttagcatcaaactttatacttctaataccaaaaggagtttcttttgtatcaacaacgttaccatctacaagaatttcgctctttgcaagatacattgaaggagaatcaacatcccaaagggaaggatttgatatttctaccgactggttgattttcatttcctttcctgcctctatcaaaaaagatgtcagtttctcgcctactttcttatttttggagtcaaaataagaagttcttacttcacctgctcttggtccggaatagtcgttcttgacccttacctcaatatttacggttgctctttcagaggaaactacaggtgtagttacaaaagttccccaaacaggaatatgcaacttatcagtaaatatcaactgagtttctctataaatacccgaaccggtataccatctgctgtctgcatatctggaatggtcaattctgacagaaattctgttttcttgtcctttcggattcaaataatctgaaatgtcataaaagaatggagagtatccatatggatggaatcctaattttctaccatttatccaatattcagaattattgtacaccccatcaaaaactatatagcatttcttatcaacgaaattgtcgggtgtatcaaatgttttactataccaaccaattccacctttaaggaaaccggtgcaaccttccgctgtagactcaaaaggaagatcaacactccaatcatggggcagattcactgttttccacgaagacggattatagtttacaaatgaataacaggcagaatcagaaagtgtaaacttccacccgttattgaaatcggaattattatttaacgcataagcgttggtaaaaagactggtcagaagaagactgacagttactaaatgttttctcatggttttaaaattgaacattagtatttgattttctgatgcaaataaaaaataaagtattgatatggatgatgggagaaatattaaaaaaacatggtgtttttatatgcatggtatttaaaaaccagaaataatgtaaatgagaacagtaattactatataatattgtgcttaaaaaattacatcctaatggacaggatacaaaaccaattcaacaataatttcgcagtcataaaaatgatttctaacaatcctagtagaattcaaattattaatgcgaaaattttttataatcaatctattctatcatatcgcataagttactcagaaagaaaatatacctatcattaataatttaggtttctgtaaactttgtacttcatcccaagtaatcttctcttactcccaccacccctttaaggtatgtcgctaaagttccttatctacccagagtataatcggtataactcgtttttctattgtctttcattggtcttttctgctgtccgcttcctcatttatcggtgttcccccatctaagagcctttctttttatacggcaaaggtatatggtcgtggtggaaatgaaagagttccggcctgcagcctttgccctgaaaaaaataacgatgttgtctgcgactgccccaacatttttttcgttcaaaacttttctaattccactcgcccgtacctaaagaagccgtaaaaaaaaggctcaaactcagatggggaatgattctcaatctaaaaaaaagtcagcggacaaaagaccaaaccaagacaaaggttttcaaaaaaaaggtctaaatctagctgaagaataattcaagtttttaaccctctaaagcatacggatatgagaaaaggtttcgaagttaacggcgattacagactgatggacagttcagaacttgtgtatattcttaccaacagcgcagtgatggtaaacaaggtacaggaaaaggaagtggtttatggcgaagagtgca

SEQ ID NO: 70 - DNA, 1392 bp, Artificial Sequence
  Synthetic sequence
agcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctagctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactg

SEQ ID NO: 71 - DNA, 6220 bp, Artificial sequence
  Synthetic sequence
ttcatcatgtcgtacgaaggcttcacatagccgcacatatccaggagaccacatcctatcgacttttgaggccattttgaaagacggctttcactttctcccagataatcgactcctgtccatataaacatacccggaacgaaatccctttcaatcaccgccttccattcgtgccactgaccgagattttctgtacccattataggcttgtcaggataattcttcttagcataatcatacatcacgcgacggtagctgaagcctgccacatcgagcgcgtcgatatatcctgactcaaagcttatggaaggcaggatgcagttggcggtaactacacgtgtggtgtccatctggcgtgtccatgcagctaatttttgcgctgtacggccaatgtcgtatgcatgtttaggctggattttccacatttctctgattttttctttagagtatggaggctgattccagaaataattaccgttggaatcggcaccgaagaaacctgtcgcctcgcggcatccggtataagtccattctatttcattacctatactccactggaagatacaggcatgattacggcttctcctcattacgtttttcaaatctctttctgcccattcctggaaatgctcgcaatagccatgcgtaggatagtcttctacagtttccttcatattgagtcttttatctttgggataatcccactcatcgaagaattcttcctgaaccagaagacctatctcatcgcacaaagacagaaactcttccgctcccggattgtgcgagaggcggatggcattgcatcctccttcctttagggttttcagacgccggtaccacacatcgcgtatcattgccgcgccaaccattccggcatcatggtgcaggcatactccttttatcttcatgtttttcccgttaaggaagaaacctttgtctgcatcaaaacggaatgtccgtatgccgaacctgacagtgttttcagaaattacttcatcgccattcttgatgcgtgtctcggctgtatagaggacaggtgtatcgacgctccacaaatcaggctgtttaatctcagatacgatgtcgataattttctcctcaccagcattcagttttatactgaagacctcaaaggctgcgatattgcctttattatccttatatactacctcaacaactgcagctctgggttcggagtagctgttgcacacggtaacctggttgtttactttagcatatttatcagtaaccacgggagtagtgacaaatgttccccaaaccggaatatgcagtctgtcggttacaatcattttcacatccctgtatatacctgaaccggtgtaccatctgctgtcggcataatggctgtggtcgacccttacagtcatacggttatcctcattgggattgagatagtctgtgacatcaaaataaaaaggagcatatcccgaaggatgatatccaagctttttgccatttatccaatactcagaattattatatactccatcgaacactatatagcatttctgatttgcactgattgttgtgggaaatgatttgctataccatcctattcctccctgaaggaaagctacacatccttcacccgaaatggaatcgtaaggtaaaccaacactccagtcatgtggcaggttcactttcttccattcatcaccagggacataagaagtatatgaataatgagcagaatctttcagtacgaatttccaatctttattgaaatcaacatttgaatcagatgctgaaacctttagggttgataataggattattaaagctaaaagatttttatttctcataatcttaggttttacatgttttttgatgtcacaaaactatatctttcacttataatatatgagggggatattaatgtgatatagggtgggaaatcagaattttacatctgccctgtattccaccgtcacctacaaccttgacaaaggatgttcctttcttccctcttatggttctcaggacaaacagacactttccgttatatgtccttacactattgtttatgacgttgatgttcaaatcttctatcgaaggcgatccattgtcgagtccggcaagttcaagcttgtcgtcgaggattatcctcacatccgaaggtatatcgactactgtgtttccttctttatcttcaatggatacttctacatggataaggtcataaccgttgtcggtagctgttttgcggtcgcagttcagtgccagacggcacggcttgccgcttgtggacaaagtgtctttcgacaatattctgtcgccgtccttgcctaccgcaaggagtgttccttccttgtatgccaccttccacatcagtatattatgctccatgaaatcgctgcgtttctttgttcccaacgatttgccgttcagaaacagttccacttctggggcgttggtatatacctgcaccagtatgtcctcgtccctgcggtacttccatttatcgcgtgtgtcgtaccactcccagcgtctgatccatcccgggcgtggagtgtaggtgaaacttccgtcagtatccatcttgaactcgctttccttttcaggtattgttacaatatgggttttcggtgtgtctttccacagacattcaaagaaatggccacgcgctgtcttgttgcccacgaaatcgaagaaagaacagtctccaccccttgcaggccatgggccgttctcgccaagatagtcgaatcctgtccacacgaagatgcccgctatgtacttcttgtcggccacggctgtccattcaaagagctgaccaacattctccgaaccgataataggctgatatggatatagcttatggtcgatttcataatatttgtctttatagttatatcccactacatcaagaacgtctgtatatccggagagacgcgaaactgacggaacaacgactcctgaagagacgggacgggtagtgtccacatccttaacccaaccggcaaggacagcggctgtttcagccaaatcgtcttttcctcctgacagacggttgaactctttcagtatagacttgttgtctgtttccgggtcgcccgtatggataagacccttgaaccctttattgtctttgctcgatgcccagtaatatggataggtccattctatttcattgcctatactccagagtatcacgcaaggatgatttctgtctcgcctgatgaacgacttgaggtcgtgctcggcatgcgtatcgaagtatctggtatatcctattgatatgctgtcgggcgcatcttccttagctcgctcagtaatccactttttctttgccaccttccattcgtcgataaattcattcattacaagaagtcccagactgtcgcacatttccagcagactttccgaatgcggattatgggctgtacgtatggcattgcagcctatggaacgaagtttcagaaggcgtcgcaacagggcatcatcgtatgcggcaacacccatacatcccaagtcgtggtgtatgttcactccttttatttttactgattttccgtttagaaggaagccttcatccgcatcgaatttaatgtcgcggataccaaattttgttgttttcttatccatcacatatccgtcagaagcaatcagagtagtatgaagctcatacatcgaaggcgtttcaagactccagagatgacaattctccagttcaacagatgcagtgaactcattgaaatcgcctttcagggcaacaaaatcatcggaaacagaagctattgtcttgccgtcgtacactacttcgtgcttcacggtgactccttttacacctgttccagcattcttcacctcgcataccacattcaccatcgaacggttgcctacctgtggtgtggtaacgaatattccgtctgaaggaatatagagctcgtttcttagaataagactcacattcctgtatataccggcaccgacataccatctgctatcggcatacgctcttctgtcaacgcagacagttattgtattcatcgaaccttttggtttcagatattgagtaagttcatattcaaatcccacatatccgttaggacggaatcccaacatatgcccgtttatccaaacctttgagttattatatacaccttcgaaatgaatgaacacttttttcccattcatatcatccgaggtgagaaaattcttcatgtaaatccccacaccgccagacagaaaaccattgcttccggctgtctgagtcttggtatatccttcgctgatactccagtcatgaggcagacacacatcctcccactttatatctggactcaggaacaaagtgtcctgaggcacgaaacctgctggtttgctgaatttccaatcgaagttgaaatccactttagtggaggttccggcataacagaatccggacagaaagatagttaagactgtgataatgttttttatggtcatatcgattttcagattaatattaatgacaaaaataatttcaaaagtgtaaaaacaaaaaaactctccatttatatttcagatatcaacggagagtttcatcattaaaaaaaataaaacattttataaagttactccttgcttaaggatagctatttcccggtatcccttcttttcgttcagtgcctgctttccgcttgccacttccaccacaaagtctataaaacgtctgcttaaagattccatgctttctccctctaccagagttccggcattgaaatcaatccacgtatgtttctgttcataaagcggagtgttggtcgaaaccttcacggttggaacgaatgttccgaacggtgttccgcggcctgttgtgaacagcacgatatggcatccggcagaagcaagagccgtacttgccactaggtcgttgcctggtgcgctcaacaggttaagtccgtgtgttgtgacacggtcgccatatttcagaacatcctccaccatcgagcttcccgacttctgtgtacatcccaatgatttctcctcaagcgtggaaatacctcccgccttgtttcccggtgaaggattttcatatattggctggtcgttgcggatgaagtagttcttgaagtcgtttatcatggccactgtgtcgtcgaatatctccttcgtgcggcaacggttcatgagcagtgtctcggctccgaacatttcaggtacctccgtgaggactgttgtcccaccctgggcaacaagatagtcagagaacaccccaagcatcggattggccgtgataccggacagtccatcagacccgccgcacttgagtcctatacgcagttttgacagggggacatcagtccgcttgtcttccctggctatggcatacatctcacggagaagtttcataccctcttctatctcatcatctactttctgagaaacaaggaaacggatcctttgggtatcatagtcacctataaactcacgaaaggcatcaggctggttgttctcacagccaagacctacgacaaggacagctccggcattgggatgaaggaccatgtcacgcaatatcttacgggtgttctcatggtcgtcacccaactgcgagcatccgtagttatgagggaaagatataatggagtcaaccccctcgcaacctgtttccttgcgaagctgctcggccaactggtttactattccgttcacgcaacccaccgtagggataatccatatctcattacgtatgccggcttctccgttagcacgcaaataccctttgaatgtatggttctcgttcgtgaatgtctgtttctcgaacttcggagtgtaagtgtatgtactcagaccggaaaggttcgtcttgacggttttctcgttcagcagatgtcctttcctgacttcctttacagcgtgcgatatggggaaaccgtattttatcaccatatcaccttctgcaaaatccttcagggcaatcttatgaccggcaggtatatcctccattaattctatggaattgccgttcacctctattacagtccctttggacaatgggtgcagtgccacagccacattgtccgcagggtttatctggatatattcagtcataacaaactaacatttataaattgaagaatacaggtagaagtatcaacctacaaggtcttttactgtctgaagcattccttcgctctggattttgttgatatagtaaattacacggtctgccagtcccgagatagtattaaggtcttcaccccaaatggaagta

SEQ ID NO: 72 - DNA, 6280 bp, Artificial sequence
  Synthetic sequence
tacagtccctttggacaatgggtgcagtgccacagccacattgtccgcagggtttatctggatatattcagtcataacaaactaacatttataaattgaagaatacaggtagaagtatcaacctacaaggtcttttactgtctgaagcattccttcgctctggattttgttgatatagtaaattacacggtctgccagtcccgagatagtattaaggtcttcaccccaaatggaagtatcggcgagaactgtcttcacaagattttctaccgagccatcgttccacaaacttgtaagcatcgccatgatttcctgtgcatcgttaggaactatctctacaccatcggcacgctttccacctttgtagtatactatgatggctgcaagaccgagtacaagtccttcaggaagcacacccttacgtttcagatattccttcactcctggaaggtcgcgtgtggcatacttagggaatgagttaagcatgattgatgttacctgatggtctacgaaaggattattgaaacgttccaggacatcatcggcaaacttcttgagttcctctttcggcaggttgagggtctccatcagctcgtcgaacatcacacgtttgatgaacttgcctatcacctcatgttggcatgcgtctctcacgatattgacgcccgaaaggaatgccaccggcgacaatacagtgtgaggaccgttcagcagagtaaccttgcgttcatgataaggctcctccgacgggacgaacagaacgttcagtcccgccttgtttgcaggaaattcttcggcaaccgattccggtgcttcgataacccacagatgaaaagcctcgccctgtacaactaaattgtcatcaaagtatagtttagtttttatgttgtctatgtctttacgagggaaacccggtacgatacggtccaccagtgtggcatatacaccacatgcagtttcaaaccatgacttgaactcttcgccaaggttccacaattcaatatactgatagattgtttccttcagtttgtgaccgttgaggaagataagctcgcatgggaagatgatgagtcctttcgacttgtcaccgttgaaatgtttgaatctgtgataaagcaactgtgtcagcttgcccggataagagcttgcaggagcatcctcaagcttgcacgacggatcgaagttgataccggcctcagtagtgttcgagattacgaatctcatatcaggctgttccgccagtgccatgaagtcattatactggctgtatggattcagcgcgcggctgatgacatcaatcattctgaatgagttcaccacctcgccattgttcagtccctgaagattgacatgatacagacagtcctgggcattgagggcatcaaccatacctttttctataggctgcaccacaacaacactgctgttgaaatctgtcttttcattcatattcgagataatccagtcgacaaacgcacgaaggaaattaccttcgccaaactgtatgatacgttccggacgtactgcctttactgcagtcttactatttaaagctttcattgtaatgccaaaaaattaaaattgataagattaaaattcaaccaacattctgaataccttacctggattttccgaccatttctgcagagcctcgcctgcctcttcaggtttcactacggcagagataagttcgttcatcgggcagttgccattctgaagataatgtatcacggcacggaaatcctcaggcattgcattgcgcgaaccgcgtatgtcgagttccttctggacaaaatattttgtctggaaagccacttcactcttggcatagccgatacatgccacacggcctgtgaaacctacaatgtcgatggcagtaacatatgtgataggactacccacagcctctatcaccacatcagccatatagccgtcagtaagttcccttactctttccaccacattttcagtcttcgaattgataaccatcgaagcacccaggcgttttgccagttcaagcttctcatcgtcaatatccaatgctattacccttgcgccacgaagcgatgctcttactatggcgccaagtccaatcattccgcaaccaatcacggccacagtatcaatgtcagttacctgagctctcgacacggcatggaaacctacgctcataggctcaatcagcgcacattccttatccgaaagaccggcagccggaataacctttgtccaagggaggacaaggaactcctgcatagaaccgttacgctgaacacccaaagtctcgttgtgttcgcaggcattcacacgtccgttgcggcatgaagcacactttccgcagttggtatatggatttactgtcacgttcattcccttctcgaaaccgacaggaacgccttcgcctatttcctctatcacagcacccacttcatgtcccgggatgacaggcatcttcaccataggatttcttcccaggtaagtattaaggtcggaaccacagaatccgacatatttgatacgaagtaaaatttctccggctccaagtgttggtttaactatatcagctacttgaacctttccggcttcagtaatttgtacagctttcataatctatgtatttatttaaatttgttattgtattattttgatgttgcattaattcaatgttgttttttctctatcttatatcctctccagccataatatgccgtaaagaagaaacatatcagaggtattacatatgccacctgatagaagtccgcgttatgattcatcacaaatgcggtgaactgagggatgcacgcattacctataatagccatcacaaggaatgccgaaccactctttgtgtcctcgccaaggtcgcgtagtgcaagtgagaactgggttggatacattatcgacatgaagaacgacactgcaagcatggcataaagtcctgtcataccaccgaacatgataattactccacacagtatgatatttactatagcgtatgtaagcagcatatcctgaggtctgaatttcgacattagcatagtacctatccatctgccgccaaggaaagccagcatatacagtccgaagaatgtggtcgcctcatcctccgacagacctgcatacatgcagcagtaaactaggaacaggctgttgatggctgtctgccctccgttatagaagaactgtgcgataactccccatctcaggtgtttgcgtttcaacactgcaaaattgataagcttgcccttctcgccgtgcgattcctccttgtcaatatcaggcaacttatacagtgcaaacaccacagcaagaataatcagcaggactgcaagaaccagataaggcatcttcatggagtctgtctccatctgaataaatccgtcccaacctccgggaaagtcggcaggcagagtctcgcgagtatagttctgtccggtaagtataagcttactcagaaacattgcggatatgaaagcaccaagaccgttgaacgactgtgcaagattcagtcttcttgaagccgtatcgtgtgtacccagagctgtcacatacggattggcagcagtttcgaggaagcacattcccgttgccatgatgaagaagattacaagatatgcccagtattcctttatctcggctgcagggaagaaaagcagaccaccgatggctgcaagaatgagaccgacaattatacccgacttatagctgaaacgtttcatgaacattgctatcggtatgggaaacaggaagtaggccagccaataggcagcttcagtgaacgaggcctcaaaagcattcagttcacaggttttcatcaactgcctgatcattgtaggcaatagattactgctgatagcccacatgaagaacaagctgaatatcagtaaaagcggtataaaatatttgtttttcattctgacatgtttttaatataaggtaactcaggcagattcttgaaaccgtaaaaggctttcgcgttctcgcccaagaaaagttttttgcttctctcttccaattcttttgatttaatcacaaagtcgtacgacatcttgtaggtaatggctgtgattgtgcgtggatagtcggaaccccacatcagtttctcgaagccaacaaggtcggcagcttcgttgatggctctgacagcgctgcggaacggatagaactcgtcattgaacagccaagtgataccgcccgactcaatcatcacattcttatgacgggcaagcattatctgcttcttccaatccggtttagtcaccataccgaaatgcccgatggcaatcttcaagtacggacattctgaaatgatttcttccatctcgcccacctggaggtctccctctgccatatctatggaaagaatcacccccttgtcttccattagatgaaacatcctcatcatctcgtccgagttgagcatcaccctaccgtccttcagttgcaggcggtgtcccggaatctttatggccttgaaccctttgtctataagttcaaccgcctggttatagaaacccggttttctgaattcacacataccacacacgaagaacctgtccggatatttcgtcatcacctccatcagatagtcattctgaatgccgtcgatatactcctgtgtgacaacagccgcgccaatcagggcataattcatattagccaggaaaacctcagccgtgtttcttccgtcaatcataaagggggggggagcatttgtctcacctcccccataaacaatgattgaccgttctctgtagtcttgattttcaggccatctacttcagtgtcctgataaagccacagatgcgaatgggcgtcaattattgtataatccatagaaacagtatttatgaatttgcccaacttactctttgctgatcgcctattatctccttaaccttttccacaaggctccagtctatcggttcctcaatgtattttatgttctgaagcacagactctgttcttgccgagctgaacaatgttgtaggtattctcggattgcttacagagaactgcaccgcaagtttctcgatagggtatccctgttcagcacaatacttggcagcctttgcacacacctcaatcaatggttttggagccggatgccattcaggaacacctctatgtgtgagaagtcccataccgaacggcgaagcgtttatcactcccacaccattttcgtcaaaatagtcgaggaagtccaccagcttgtcgtcgttcaatgaatagtgacagaagttaagcaccgcctctactgtacccggagcggcatggtcgataatccatttcaggttttcgagctgcaggtcggtgatacccacgtggcccaccacgcctttcttcttcagttccaccagagcaggcaatgtctcgttcaccacctggttcatatccgagaactcaacgtcgtgaacgttgataaggtcgatatagtcgatgttcagacgttccatactttcgtaaacactctcctgagcgcgtttgtccgagtagtcccacgtattcacaccgtccttgccatagcgtcccacctttgtagaaaggatgaacgattctcttggcaattccttcagagccttacccaatacggtttcggctttataatgtccgtaatatggagaaacatcaataaagttcagtccgcgttccactgctgtaaaaacagactgtatagcgtcactttctttgatagaatgaaaaactccgcccaatgaagatgcgccataactcaatacaggaaccttaagtcctgtctttcccaattcacgatattccatttttgataaataatttaaaggttaatattttttactctgtttattcttattcatacagatagaacatacgttccatcatcttccatttctcgtccgatgtggccccctcggcacactgctggaatttggctacgtattcttcccattcggcctgacgcggcagagtggcaagctttgccatagctgtatcccagtcaaaatccagaggtgtttccactatcataaagagttttgaccccaatatgtatatttccatttccaggattcccacctcgcgtattccggcgcgtatctcaggccatgcctcttccttactgtgagcctttctgtaggcttcaatcaattccggattctcacgcagactcaatgtctgacagtatctcttcacaggcagggaataacttttcactttatatccttctgtcttcatgatattattgatattaatatgttagtattacatgtcactgtctttatcttttcgacgatgctaaagtatg

SEQ ID NO: 73 - DNA, 6247 bp, Artificial sequence
  Synthetic sequence
tttccatttccaggattcccacctcgcgtattccggcgcgtatctcaggccatgcctcttccttactgtgagcctttctgtaggcttcaatcaattccggattctcacgcagactcaatgtctgacagtatctcttcacaggcagggaataacttttcactttatatccttctgtcttcatgatattattgatattaatatgttagtattacatgtcactgtctttatcttttcgacgatgctaaagtatgaagtatccatcaaaacaatagaggagattttcaaaaaagaaagaggggatattataccccctctttttcgacatttttacccctcataaaggagataaaaagtcaccccaaactctataaaaaatcaaaacagattgaactgcattcctgtgtagaaaaatccctggttggatttcggattccaatacgtcatcaccgtcaacgggatttcatattccataatccgaagtttataaatcacattcagggacacctgagtaattcctgccgattcggcatacatggttctgttcaccatttccccgctttcatttcttgaatttctcaatgcgaaagctgttccaataccaggaccgacccttagcttttcgttctgatagatggtatagcccacatatacgaaactggagtagatgttcttgctgttgtccagatccctgtcgcgaccgtaaacaagtgtagagaagctcaactccagcggaaatttcctgtcgcccgtataattgaccatgagatcaacgaaacgtccagtttcatcaggcttatagttgaagaactccttattattatatgtagccccgggcgagaaattatatgtatctatagcctttatctgaaacctgccatgagtatatgctatatactggctcagctccttataactccccctggtgttcgatccgccaaggaaaccggcggtaaacctccccgatgggtcggaaaccgacaaatcggacgagagaatcagtccgtcggccacttcaatgccacgccatagaatcatgttctgtagagtagtactgaaatgaagctgagcctgaacatttgctgacaaaaatataaatacaggaattaacagtcgctttttatacttacaggtatccaatgataatatatgtatcatactcagagcagtagaaaatcggttttaaattattattatggatttatttgtcgaaatactctataagattataaacattccagttaatatccgacatgtatttggtcaatgatgtataaggtttatagttataatcgagcatacctttattgcaatcctcatcatccagatacttgaagaaaacccatcctacacaattcttggcttcgagcagtcccaaggtaaaatgctggtaagcgaatccacggttttgctggtcgcgtaccacgaaaccagctccacttgaattgtcaagcttagtatcctcacccttggtatagaattccgttaccatgaaaggagtaccgcccgcctggttcttccagccatccatgtagcctttttcaggcgaccatttactataataatttatggaaatgacatcacaatattttcccgctgccttaattatataactgttgtatttaggaaggctgtgcaggcgtgaacccagataaagcaattcaggatccttcgatgccttaaccgcattctttatggcagaataatatttttccgcacaaataccggcaaactcattgttcagttcatccgttacatcagaaacatttgcactcttgtccttatccgtcataaacttggcggctgcaatataagcaggatcctgcttgtttgaaattttcaggaatctgtcgagcagcctgtttccccatgtagagaagtctatctcattatccgagaagaatcccaacacatccgggttgtttctgaacatgccgaaagcatccgaattgagatactccttgcaccattcatcccatccatcataaaacacaagacctatcttaagattcacgttctgccccggatagctaattcccttgctattcttgaactctgcaaggaatgaaaaggaaggagcctgtgtcagaggacttgaagccgatttattataatcatttacagccttgtcgccttcttccttaccgaaagcgcagacactatgaaatcctatttcagagaattgtttctgcgactttgccacccagtcatctactgaactgtaaagcttgccgaaagctgagctgttgccatccattctgaatgaggcgataccccttacataatatggataaccttcggggtcgactatccaacttcttccatttgagtttttctcaaccctgaaccgtccagtagccttggatttttgcccttttgcgtatgagccatatttattcacgctttgcaaatactcatcctgtgtttttgtctgctgttcataaccaaccaggtatggcaatatccttgtctttgcctctataaaagccttgtcaggtttttccgcatactcgacaattatcggttgatactgcttggtgctattaggataggtttcagcaggaccgggaacaggcagttgcagttctacatcatcatcgtcattatcgcctgcattgtcgccgggagtattatagtcctccacattccccggttgtgagtaaataacctcaggcggaatatatgagaactcctcctgagggtcttcacatgacaaagcgaagaacggaacactcaagcaaatggttttagtaataatagtagaatatttcattgttgcaaatatttagtaaattaatataaatcccatgtcctgattgtatccccccatcggtggtctatcgggaactccatttctccccatgccttaacagaagtccaaggttggtcggcatcagtccagaatgggtcagaggcaggcaatcccaacggaaggaatgcaagtgtagtcatatacaggctgccattgtttgtataatgattcgaaatgccagtctgatgtccgcagaatcctatggtgaggaatccgccctcattgaagttattgcccgacttgaacatacgtttcatacacgctgtcagcgcacatctcacctgtgctttcgatactcccgccggcaactcattataccatgctataagagccagtggctgcattgttgccatacggtaaggtatagagcgtccgaaaacagggaatgttccttcaggagatatgaaacgctccagaatcatggcgaacctctgtgccctcatcaatgccctgtcatagtacttgcgatagtcgaaacgtgtcctcacgcccgattccattattgcatgtatagattcgagatacataggatggaacacataactgctataataatcgaatgcaaagtgctgtccgtctgcgtaccatccgtcgcctacataccattcctccaccttgcggaaagtagaatttatacgatatgtatcctgtccggcatcaattttggcaaggaagctttcaatggtggccgagaacagcagccagttagtgtaaggagggtcaatgcgtcggagacctttgaactcttttatgtagcgttcctttgttgtctggtccagcggtttccacagctggtcgaacgcgcgcaggaaactttccgcaatataggcagcatcaaccagtgcctgaccatgaccgttccacaacagataatccggactattagggtccaccgcatttgcataactcttcaatgcccattctttcagttgcttgcgctgctgtccttctgctgtatcatcgtcaggcaggctcaaccatggagctataccggccatgagacgtccgaaagtttccatatatgcaaccttcttgttacggttatcccagtttggacttacctcaagaatcatatttttctgcagttcccctttcgccatattgctcaacacaggagcagccatcctgtaagccatatccgtccagtattttcttgtctcgttgttgtttgcctcgagataacgcacatactcgcaagcggcaagaaggaatgcgcctaccccaaagttggcagtcgacttggcgtcaaccacctgtcccggaatagccttttcaccgattggctggacataacccaccgaccagtctttctgcagtgcagtcttggtaagatatttccatgctttccccactacaggcataaattcatccttgtcaagataaccgttgtttatcccccaaagcataccgtaagtgaagaaagcggtaccgcttgtttccggtcccggagcatgttccggatccatcatacttcttgtccagtagccctccggctgctgcagacatgcaaccgcctttgccatacgcacaaacttatcctcgaaaaaagacagatgctcataaccctccggcaggtccttcagcacctttgccagagcggcaagcacccatccgtcgcctcttgcccagaaatccttctttccgttcagactcttatgcttgggataaacatattttgcgtcgcgataatagagtccttcctcctcatcatacattattgagtccgacgtacaaagatattcatacagtttcttaagataccggtgattatgcgtaatcttatacatcttcgtcattaccggcatcaccatataaagtccgtcgctccaccaccagtaatccttacgcggtgtgctcatctggtactccatgacttcgcgtgcacgcttgattttataattctccggcatgacgttatacaagtccgcataagtctggaagcacacctgataatcgccgaacagcacataatcatcctttaccccgtatttatacttccattcagatttgttgttgcttttcgcacccatccactggttatactcagcccatgcctccgaatactttctgtattcttctttcccagtaaggaaataggcttccatattaccggtgtgatatgccgcataatcccagaaagaccttgcttcgggggcatgatttttctgccaggcatcgttcactttttcaatcatctccctaacttgctgagcctcagtttttttttgcgaaggaaaatgaaggtaaaacagctataaggatgtataacatccagtagtatctataacagttcatctttgtgatattgtttacattttctaaaacgaaatggggaagaatatatattcctccctcatttcacgaataattgtattattatatttatttgttaggagtccattctgctccgttgttgaaaccttctgttgtagagtcaaaacttgcatctgctcctgtacttggtctttctgtaatttcttcaatcttaaaagaagtgattttagcggttccagtagcatcagtaccaccagggacattagtctgtacagttaaaataacgttctcaagaaccggccacacaagtgaaccatctgctcttgaagctggagtttcagcagaagtagaactactgattgtgaatgtatttgtataggttccacttccggtatttcttccaatccagaatttatatttatcagatgctcccaatctgaatgttgttgcacagtcgttagatgcgtatgtataagtaaatttgtaagtacaaccatcacggaatgacattgatttagtaactgggaattgattatctgctggaacaatttccaattctccacttgcattaattttttcggcaactccttctgcaagatattccttaactgcatctatgttagcgaagttaaaatcaaaagcatctgcatgagtcaaagcaacattggcagattcaatcttgatattagcatcttcgttgttttcgtttttagcagtcaaagcactaacagcataatcagtgttataacttacgctaatatttgcgtcattactataaatcttatcaccaagaataagagtcatagtagttccattcacagaaccggaagcaacaggaattgtttttcctgctactgttatggtaaatgctttgttaacagcatcagtgaatgttccagaaacttccttatcgagtgtaagttcaattcggtcattacctgttgtctgatcaggaacaatttctttagctgaagaaacggcaacagtagtttgtttttccaaatccacaggaggttcaccgcctccttgatcatcattcaatactatcgttacaatctgtcctttagtaactataaggttttcaccactgaagttataagttttagtaccagaatttcttgtaagttctaaagtaaatccatcggtaaatgtcaccggagctac

SEQ ID NO: 74 - DNA, 6169 bp, Artificial sequence
  Synthetic sequence
tctttagctgaagaaacggcaacagtagtttgtttttccaaatccacaggaggttcaccgcctccttgatcatcattcaatactatcgttacaatctgtcctttagtaactataaggttttcaccactgaagttataagttttagtaccagaatttcttgtaagttctaaagtaaatccatcggtaaatgtcaccggagctacaaccattgagtattccttggcatttttattttgttcattaggaccaacaaatgttccctctttagcggttagagttataacattagaaccggattccactgtcaggtttgctgaagcatcaatttttacgttccctgcaatctttacatcaccaccagcagtaagtttaatacctgtaaggtcagtaagattatttttaaacttaaccaatccacaagtattctggaaagttaaagatttgttattatctgttgcagtagcataagatatatttgcatttgcatcgaatccccaagccggagctgtctgttcagatggcagtgtagtagttacgacaccttcaagacacacagcttcggcattataaggataaagagctgtatatgaattgttaggtgtagccttacctgtaaacgttgtaactgtgctaccacctgtagcggtagtaaacttgttattttcttggcctgaaaagatattgattgcatctcctgttgtccaccacaccgttgttccattctgcaacgaactacggcttgaaggcgtaccggcaacaaaagtcatatcctgaggaccactgactgcatttacattcgacagttcgtcttttgtacaagactggagcattgcaatactcatcaaagccgctccacaaaatagcatcgtatttttcatgacataaattatttgttaaacagtttcaataataaaaaatcacatcacttgttattcatattcttattctttaggatcaggtttccattcagtaccgtcatcttcaaaatcatcatgaccgccatctacaattccgggaggtattgatattcggcataccgcactttttattccattacccgtatctacagaagcaccgatattagaatctctgcccccgtcgattgccacgaccgtacatctcattttatcgtccgatggtgtaatcatcaacacatcagggaaagaagttccccaaactattgacttgtaaccggtataagggagattatccttggttatattaatacccaactccacagtgccactatatggtaattctatataactgacaggtttgttgtcagtctgcccatccttgaacactacatattcaatttttatctcctcagctggtgttccatcacctccacctacgccatcatcatccttatcacacgagattgccgtaaactgtataaaaagaagtatgaaaaggttgtatactgacagaatccgtggttttatatcaaccataataaaatgttatttaagcgccaaacaaaattttcaatattcaaaaggcataagaggaaaccctgaatatgccttattaccatgaaaacaaatcaatctacctttttcaatccggaatcagaaaaatatgttatttatttagaacatatttttccgatttgccagattacaatcacaataaataaatcaacaactaaatctaattacctaatcttataactaaaccctcaaacaatgttatttaaccttttctatcttgacatcatcaagcaggaagcatccaccattacctgaacccggaacagctgtgaaacgatatacaaaaccattttcctgcaatttgaatttaactgttgtaagattgtaattcttacggtctttcttgacctcagcagtggcaatttcttccagtttctttgaatccggattatagtactcaatcctgaagttaggtttgtcaccccaactgtatttggtataagctgaaatctgatattctgctccagtttcatagctgatgtttacagcctgccacataccaaccttcacctcaacagcatagttgcctgaatgtgcctttttcgcatcaactattttgttatctttcttttcccagacattccatgatgtcaagtcacctgactcaaaatcaccgttcttaatttcctgagcgtatgcagaagtcatcatcattccgcaagccatcattgctaaaatttcttttttcattttttctaaggtttttaatttaagtattatgttgtatctattaaaatcactcttctattggaaccaacttataagccctgacccagtcataataagtagtacttttgtccttatccttcaagtcctcagctgtaggtacttgtttttcccaatcgtatgtttcagtaactatatgtatgaacataggtcggtcaaacggagtatctgtatattttgttgtaggcttgatagtgtacatatactttccgtcataatagaatttcacggtatttgcatccacccaccaacaaccgtaagtatggaaatcttctgccgatgggtccgtcatatacgaaaccacatccgaacgtttcgccgtattgtcagtacgtttgcctccttgttcctgataccaatagtgagtattactgttcatctgcatattccatgtcttgttccacggattatcagggttgacacttcttattatacccattgtttctataatatcaagttcctgactgctccatgtctttatcttcttgccgcctttcattatttccttcattaccgggcggttggaaagccaaaaagtagacgacatggtagtgagcgaagccttcatccttgtttcataatacccataatgtgcctggttctttgcagaagcaaccgctccaccggcaagacgatatttatcgcccggctttccatcaagtccttctgttggcgacaaaacggtattgattatacgaagacaacctttcttgacactaacattctctgccttgaaagttgcaggcggccgaccgttagtccaataaggacttttagcatgccatttagcggcattaagacgtttaccattgaattcatcagtataatcttcgttaactacccatttataaccctcaggagcctcaggcaaattttttatatgctcttcagccaaagaatattccttatcattttttaatgtataagatgacaggaataaagatgcagcagataaatacaatactgtttttctcataaactttgtcgttttagattttttgttacacgacaaaagtatataagtttcatgaaagcattaagggggatttacatcgtaaaaggtggggtaaaattctaccactccctgaaacacaattatttcactcatgaaaccatgtgtttttacgatatataaaacccgacagaagaataataccgtattaccggctaatttacataagaataacttttcaaaccgccatataccccactttacgtccgtaccctcagtcctcgactccggcaatatgttttccatatcgagatctatggttttctgcctcggattcaaccactaactgtcgagcatgtggattgcgtatctgtcatagaatctctttccgaaccatattatctcgtctgtgctaagtatgttgttcagacggataatctttccggtattttaccacctacttctcttgcaaatcctgatctgatataaccggatactctcaattcattgatttccgacttgtatacagtctgcgaagaggcattgaaactactgcacagactgaacagcagcaggggaataatttaactgattttaatagtagacattctgtgttcataatatttcattttaatgattacgtttctgactttcgtctgatgcaaaattatgaggtatcggacggggttgtatctttcagtaaaaatcagtaaagtcttggcaaggggtaaaaaacttaacatcttgtatataaatatattacaaacaaggtgcaaagattttcagtaaacgatggcgaatacagaacctatatatttacacgccataaaatgaagaaaaagcagtaggaaaaaaatgcgggcaagttccggataaaatgtgggcaagtttaaggtaaaacttgcccgcattttagatagaatgcgatcgcatttaaaacaagtaaaaaacgaagaaaaaaaatatgtgttcttcacagaacacatatttcaaaaataggtataaacacgctaaacaatgttaacaaaatctatttataaaaaaagctcacatcaataatatctgcaacatttttacaatactccataaatgaagagaccttgggatgatttatacacagagctatctgtgatgtaggcgaaaaacgtcctgtcccgtcaagaaacgctgtaagctcagatgggaggagtatactgccaatacctggatttacgtcagtcagaacgactgtatttacagcttccaccgctgacacatcaagataatcgagtgccggaagatctgcgaagtgcaattttcctatcatattgccgcctttgctgccctgaagagagacactctccaatgaagaacaaccggatatatggatttcactgtcgaatattgaagtttcggaaacatcatcattaagtataacagaaggaacaactaccaattgaagcgaactgttattctccaccctaagtactttcaatgatgatgcggaacttaaatccattcccaaaggtgtatcaatattagagattgaaaatactgaaactcccgaagacggcttgacatacgacatggaataatgcttggacttcactcccgaaatgtctacttttcctctgaaaccgggatttgacaatatatactccacaccctcaaggttagctgtctgcgacaggaaaatgaggtcgttcccttcggttatcctcttcgtgacatcaatctccaacgatgagacaaacaccgacgggaagtttctgtaaagatatgaacggagcaaaggatccggtactcttcggtttactgtatattcagtgtaatttccatcctcgtccgacatcacgacaagacatttgtccgtcatggctttatagaatgcaggtatgacatctgtattccattttgcaaagtaaggaagtttcagatttgtaagacttttacaaagcaccgtagtgccatcggttgaaataagattgagatacgaagttatgccgtcattgccgcgtaaagctaccgattttattccttcgggcaggtcagcaaagtcgaatatagaaaaactgttacactcaagattgacatctgcgagcgaaggaaaactcctcaaaccgctaatagatgtaagttcgcatctactcaagtccaaagaagtggtattgagaacttgattgtcacaaatcagctctccgttttcgctgaaattaaatcctttccgggtcaagacatcgcgtaactttgtatcaaaagtcacttcagacacttcaaagtcggaaatttctgtttcatccttacacgagattattgtgaaacagagaactatcagtacataaaagctaataaaattcctcataacaatcagttttgtggtaataagactatattatcaatccaagccgcgtcgttctgtctttcgcacacaatggcacacactacttttttcactgtagaattaaaatcgaaagatacggctttataattgccgggagaagaaaattcctctgtatataccgttcctgtagacatatcctgtagcatgactttcaacttacatgctccttcggtctttacatcagcagagaagcgataagtcctgccactctccatgtcaaccctctgcatgagtcctgcatgaccagatatacaggctacattattgcctgcattgtcagtctgtacgcaaaccgtaccatagttacccaatggctgccatgctgaaagtccttcgctgaaggttccattctgcaaggtagagacagtatatttctcaacctgcagtatcatggacgatacgtgacctcctccgtcggaaaaggtgatgtcgacattattatcgccattcttcagcagctgtatgtcgaacggtacttctatcataccgaaaaatatattgcggttgctctggccgtagcctttccagttgtcgggaacactcacagcggtaccattaatctttaccaccggtttcttggaagcagagacaggacggcctatcgacatacgcaagctt

SEQ ID NO: 75 - DNA, 6232 bp, Artificial sequence
  Synthetic sequence
ttatcgccattcttcagcagctgtatgtcgaacggtacttctatcataccgaaaaatatattgcggttgctctggccgtagcctttccagttgtcgggaacactcacagcggtaccattaatctttaccaccggtttcttggaagcagagacaggacggcctatcgacatacgcaagcttgctctgcccgaaccggactcgattcctgtgaaggggaacgaaagggatgatccggcggaaatcggtttcagatactcactgctgtaatatttattgcggattatggagttcgtgaatgctgacgaagacacatctgctacaaggactatggtctgatttgggacaattgagatgctttcaggcatggacgggacattctgttccgtatattctatacctgcgttataattgacatatagagaacgctttgtgacattcgatacatccttccagctattcttattgttcagatatacagtctgcgggttatcatcaagattatcaagggcgatatagagtctgcctccatccttgaatgcctgtacctgaatatcaggattactgctggttatatcaacacgttcgccttttacattcttccagagttcgaagaaatattttttgtcattaagcctccatgtggtattcttcagattctgaggattgtcgggaataaacagtgccgcactatatgaagtataattgtttgcagcggtgatatgccactcagccttatctgagacaaaaggtattgagataaacaaattgtcctgacgttccatcagattaaacagaaaatgattaaacgacgaaacactccgcacactgcttatgtcatcatagctgtcgtcgggcttgctgttgtcaatacctccaaactcggaaatggcaagaggcttgacatgtccgaacttaatataggaatacgcctcaaccatatcaagaactgcttcggagttacttcctgaacgtttcgtatcggtgccggttacatttattccatcataaagatgtacagagaatccatccatatatgcacctgcccgatcgatgaacattttcatgcgggtgttccagtaattgaagttcccatcctcccaggcggggtaggctgcggcatagcctatcaccttcatctttccgttaagacgcggattattgtgtatatgtttacctattgaagcataaaaatcgaccatcagttcgcgcatagcctgtccctgaacggtaaaaccggcatcatttgcatgaacgaacggttcattgaggggttcaaaaaactcaggtaccagctcgctgttggaataatactcagccgaccatgcacctgcagcctgaacgtctatgccgccctgtatgtgctgtacatagggatgctctgtggcaatatatctttttacggaaatatttccgctgtatggtttcatctgaggatatttgcctacctcatgcgtcttgttatacgcatacgagtatggtccccagaactttcttccaagaccgacctgatagtcggcaagaaacttgcctacatccttatcatcatcggaggtggaatgaatattgaaatatttagaacggtcgagttctgaaacaccgctcaaaaagcgacgggtattatagtcgacaaccacctcgttcctttcctgacaataaataccgggaggaacacctagggtaaatgccgataacagaaaaatatatttatagctcataatttctttccttttagacacagaaacttgtcagtcctgatgtggatacattattttctcactttcttatcgtagcgttcagtctgaagaatcatagtagccacacggcctccattatccgggaatgttactgacaccgaattttttccttttctgattaaccggtagtcgaaaggtatttctatcataccgaagaaatcgtctctgccggtctggtcatatcctctccaattgtcgggcatgtcgactttcttgccattaaccattatttcaggtttcttcgacatctcgtgcttcctgcctattgacatacgcagaacagctcttcctgtacccggtttcagaccatcgaaatcaaacacaattggttttccggcttccaccggctgaagataagtgttgctataatatttagtacgaactattctgtttgaatactttttacggatgatgtcggcacacaatattattgtctcatcttttataatgtcaatactttgaggcatcgagttcagcgtcttttcatcataaactatacctttatcgaaaatcatcttcaaagagcgcacagaaacattatctacacccttccaattcagtacgtttttcaagtttaccttatgtgtatagtcatcaagattgtcgacagctatgtaaagcctgtcatcgtccttaaaagctgccacctgtatgtccggattgtcggaaacaatatctacacgttcgcctttcacatccttccataacttgaagaaatatttcttgtcgttcagtttccatgcggtattcttcaagtcgtgaggattgttggcaacaaataaagcagctccgtatggttcgaaattatattgtttcgttatatgccattcggccttgtcagaaacaaagggtattgagatgagcatcttgtcttcgcgttcaagaagattgaacagtatatgattgaacgaagcgacagttcgtacagaggctatcggattatatcctttggaagtgttgtctattcctccatattcggttacggcaagaggaagaactttccccaagcggatgaacgagtagttttccataaggtcgagaatagcttcggaattacttcccgaacggcgggaactcttgcctactatgtttattccatcgtaaagatgtaccgacaagccatccatgtactccccggcacggtcaatgaacatcttcatagtattattccaatggtcgaaatcgcgcaactccatagccggatatgccgcggcatatccaatgattttcatttttttcagacttggctcagcgtgaatatgctttcctgtctgtgcataaaaatctgccatgagcatcctcatttcctgaccatgcatattgaaacatttgtcgcgtgcatggacaaagggttcgttaatgggttcgaaaaattcaggaactgcccctttcacatgcttggaatagtattcggcagcccatgcacccgccttcactgggtctatgccccattgtatggtacgcgcgttggcatgttccgtagcgacatatcgttttgtttccttcaaatcagtgtagttcaaaggcttttctgaaaaaggatattcgccaaccttttttgtcttgccatatgaataagagaacggtccccagaaagagcggccgattcctacaccgtaatctgcaagaaatttcctgacatctggatcagaatctttagatgtgtgtatattgaaatatttacctctgtcaagtgccgatacatcattcaggtatctctgagtggcataatccactgtgacagtagtgttataagtcttattctcggaagatgataaaggaaaaaccgagaaagacaaacacacagacaaagctgtaagaattatgttattcattgtattatcaaaatttaaaaggcagagaacactccgatagttcaattaaagtattccctgccattaagattatcacttctgtttaaacactaatatcagaaatcggccggtttgagtacatcgttcagcaccacttcatattcaacttctgttccgtcgttttcagtaacagtaagatggccgtaaccgccacttgagttattttctttcttaccttcaaacatgaacattctcttcttcgtcacttcctgttcttctttatcgcctgtttcaggattgataacttcttccttttcagtatagacttcattgaaagagaatgagagatgtttttctgtatccgaattgattttcagccactcgggcaattccgaaggagcctcagacgactcggcaaagaactcgatcttattcattctcaaagtctgatagtcattcttccaggcaatgaggtcgaacaattcgcgataaacagaaaacttggaaacctcgcctgtctttcctgtttccacattcttgagataggtaagttcatacacgggagtagaatcaagttcgacctcagcccatttgtcattatcacatgctccgaacaaaaccaaagcacataagaatgtaattgtcttataaattttatctattagcttcattgttactataatttattatggtcttacttcaatatatccgaaaaatatatcgtcaaaataaatattatccttaaaggcattaaagcgcatactgagcaatatattgtccatttcagcctttgaagtcacagtggttgtggccgacatccatttgctgtcggagccattcacaatgccgcaccatggtctatcgctctgccatgtcatatcttcagctccttctttacctgccggaacgaaatacggactcatacccttaccctgtttataccccggtgtataatatttgtagctgaaagtatatgtacctttaccaccagtaaatgtcttggagagtaatgccctgcatcggtcaaatgcttcgacaaacatacattttgcactgttgtttattccatccttcagaggattgtccacaacctgtgaaggaactacaggatgtgttttggtatcggcatcaataactttccagtcggcatatgtgtcagaattttcaaaatcttcatccaggaacgcaccaaaagtagtcgctacgtttggagctgtagcctttatctcaaggttctgatatccaaccaacgcttcagttaaagttcctgtaagggtcagttcatctgtgttatagattttctcaaccaaagtaagaatcagttcatatctgctttgcttgtttacttctgctgctgtgatgtttacgctacccctgacagctgacggtctgttatacgagttggagtaagtaagctttagagatgatggatttatctctttatatccaaactcagaattatccaaatctatagcaatgtgtgtttggtcaatctgacggatgttataagtaataggatcatcactaggtactactgtaatagccaaaggcacaacaagagtttttggcgaagcttttggagtgtacttacctttaccctcactggcagaagttctttctattgtcatggaaagaagcaatggcttatcgctgaatttctttgcagtgaactggtatggagtgtcaaaactggttaattcgtcatttacgccagtatccgcacatttgaaagtccatttgttaggcaatccgtatgaatcgtccttaatatagacagacttaccatattcaagttcgtatttttcgtattcgggagcttcctcagttccaccgactattccggtctttatttcctgtgtacactccggatcactgtatacctttacggccggtacgaggttaggatcatacacgcggatatggaaagttgtatccatcacatatacatcaccctcctgcttagcataacaatattttttgatatatcctccggtattgtcgtcatacaccgaatatggatatacaacctgtctgcggaaagtattgcacaaacgtaccgtatggtcaccgggtttagtgaaatacacatgtatggttttcaaatcgttggtatgagggatggattcatcaatcaggtttgtatagtctgtctgtccccactccatcttaccattaaggaactttgtaccatcatccgacacaacccactgatgcgacaacatgccttgggataagtccattatacttatatagttattaagattcagctgaataggtgaaacgttttcctgatctgtactcacatgccaggtacattcagccacgttattcaacggttcaaactcatcatccttacaagatgtcagaaccgagattaatgaaagagcaatatataaaaatctatttttcatcgtatttatttattaatatcaggatttgatgtaatttctatatttggaataggccagtatgccacttgcggaccgtagttcaatgatgcttggaaataatccacaaaagcgtttcctctcttttctggcggcagctcataaaatctgtactgctttccaaagttgaatgctgataccaaagcattagggtcatcaggattaggcttaagatatttggtctgaatcatacagtacttatattcgtcggatgcca

SEQ ID NO: 76 - DNA, 6187 bp, Artificial sequence
  Synthetic sequence
tttggaataggccagtatgccacttgcggaccgtagttcaatgatgcttggaaataatccacaaaagcgtttcctctcttttctggcggcagctcataaaatctgtactgctttccaaagttgaatgctgataccaaagcattagggtcatcaggattaggcttaagatatttggtctgaatcatacagtacttatattcgtcggatgccaactgatcaaacctttccttagttatattccagcgtctcaaatcaatgacacgtatggcatgtccttccatacacagttcaagaggacgttccacatacatcagatgattcattacatcacttgcagcatattccttctcatcgtatgtatatctcttgaattctccctgttccgattttccgataagcacaactccagcacggtgacgtaccttgttgatggcattgatagctgactgaacatttccatcgcttgcaccgcctttaatcagacattctgcatacatcagatatatatctgccaaacggataagacgatagtttattcctgaggccatagcaggcttaaattcagtttcactcttacgtgtatcccaatttgataattttctgaaatacgctgaagagccacggttgaattttgatacctgttgtgggagagactgataatatatcagactttcatcgccgtttattgcaagagaggcagatgcacgcatggaatagcttctgaggcgatatgcctgaccgtcttcccatttaaattccggaactatgtcatcgtagccggtaatcttattgtataaaactttattatctccgacagttgagacgagtcgttcgcgtactccaacatattttcctgctgttgcatcccacgtataaacgtacgttctgttatatacgacaccctgacggtccacctgcgagctgaaagttgttcccaactggtcgtatataatatccctatgttcaggatcaccataattgtcggactgcatttttatccagttacgttcatcaagtctgtccaccggctctgtttcgaatgcttcaacaagccaaaaagcaggaacagtgttaagccaggcatcgcccaagccatttacattcattccccatatattatataaggtagactccgaccatgtaccgaattctgtattatactgtgtagaataggaaacctcgagaatagattccgaattgaattcattggcagcagtaaaattatcgactatgtcatcaaccaaagcaaaacctccattatcaataatatccttaaaatattcggcagctttattatactctttatcataaaggtagcttttgcctaatattgcctttacagcccaagaggtgatacgtcccaaatcggttttctcccatttgtcattcaagccaaggtcaagagctttctgtaaatcttctctgtaatatttcttgatttcatcacttggtgtaacctttttatagtaatcttcttctacctctgcaatttcattaatataaggaacattaccattattgaatgaattattgagataaaaataaaacaagccacgcaaagaatatgcctgtgcctcaatctgagcaagcttggttatttgaggttcatctgtaacatttggacggattttctctatactggccagaacctgattcgcacggaacacaccagtatacagtgcagaccatttaccacggactgttccgtatgaatcattaaaggtttgcttataggcttcgttatcaaactgctttctgtccttattaccttcaactgctatatcacttctacggttctcatcgagcggatgataaatattggtatttttcaaagcattatatacagcagccagtcctttctcgcagtcgcctattgttttataaaaattctgtgttgtcagctgatgtatgttttcctgcgtaaggaaatcgtcgcatgaaaccaatgtcatgcccgacatcaacagactgaatactattgttttatatctgaagttcatatatttatattattaaaagttagaaattaatctggaatccgccacgcatctggatacttataggatatgttccatagtccaaaccacgacgtgacaatccattactaccgacctcagggtcgtatccgtcgtattttgtcagtgtaagaagattatcggctgcaacgtataaacggaacttgcccaatccaagctttgatacccaactcttggggaatgaatatcctaacataatatttttaagtctgacaaatgaaccgtcctcaatccacatatcagtatgagcacgatagttgttatgcccctctgtacgataagaaggaatggtagaggtatagttggtaggggtccacatgtatatcagttccttattggttcttctttgatatgtatatatcttcgtaccgtttattatttcatttccaactgaagcataccagttcatagagaaatcgaagcctctatagtcggccgagaagttcaaaccaagttcataatccggcataccactaccggcataaacacggtcgtcatcattaagaacaccatcattattggtatcgatatacataaggtcacccatacgggcacttgactgtaatttctgatattctgcaagcttctgttcagtattgattacccctgcggttggcataacaaagaaagcaccggcttcatatcctttcttgattgcagttacataatcacttcctgatgaaacaggtttaccgtcggggaagaaatataactcattttttcctgccatagacacaatctcattcacgtttttggtaaatgtaccagtcaagctgtaattaacaccacgtattttgttgcggtgagtaagtgaaaactcaacaccacggttttccatatctccggcattcaatgtaacagttgaactctggccccctccatttgacggtggcacgaccatcgggaaaagcatattcttcttgttactcttgtacaaatcaagacctaagataagcttgttattatataaagccatgtcgataccggcattaagctgctgggttgtttcccatttcacattcggattggcaaatcccaattgggtaaaaccatttgcaagaatttcggaagttccggtaccaaaagtatagtcgtagtttttgtatatagctggtgcgtatgaataatcagggaagttctgattaccggtagtaccatagctgaatcttaattttaacgaatttactagccacctgaatctgtcgaagaatgattcctcagaaatattccatcctacagacaatgacgggaacaatccccaacgattttcttcggagaacttagatgaaccgtcgcgcctgatactggcacttgccatgtatttgtctgcatagctatattgtagacgacccaacataccaaccattgtactgatacggtcctgtccccactggccactgcctgtacccacagtcatatcggatgttcccgcatttaggttcggaatctcgttagtaaccaaatccattatactggcatagaacatctcgtatgtatatttctccatactgaaaactccggtaaatttaatatcatgcttttttatcttcttattataatttaccattgtttcccaagtgagactggtattctttgaatgagtatcttttaattgcgaacggtaattagagctggttaccttttcgcctttctgattatatacctcaaactcaggtcgaattgagacagctttctgattgttatatccaaagcccaaacgtgtggaaacattcagtccgggaattacattataagcaagataaaaattaccgttaaatgattctgtgtccttatgattttcctctttcaatcttcccaatgtataacttacgccctgtaaatctgcaggatcgccagctgcatttactatacttgcctgtggataaatctgagaacgagtaggcgagtagtcataacattcgttcaataacccccaagccggagataactggttttctatcttcatagcgatgttagtgttgatagtccattttccgcgctgaaaatgtgtattcgaacgaatattatatcttttgtaatcggaatttatcaacacacctttctggtcgaaatagttcgcggtaaggttatatgtcaaatctttcttgccgccattcgcagtaacagaataattctgtattggtgcgttattattgactacatattcatataaactagagttgttgaagaaattcacaggatatgttttcagattagaccaggccaggtcgtctgtattctggtttccttccatcattctgttagacatcacttttacaaatatactctcgttggcatcaagcaaatgaatattcgaagtaatgtgctgtacaccataatatccgtcgacagctatcttcatttctccttccttacccttctttgtggtaataaggataacaccggaagcaccgcgagtaccataaatggcagccgaagcagcatccttaagaatatctatacttgctatttcgctactactcaatcccgggtcgccctcgaacgggacaccatcgacaacatataaaggagaactgtcgcctgagatagaacttaaaccacgaatctggatgttggatttggctccaggctcaccagaacttgcctgaacgttaactccggcaaccataccctgaagagctgtacccaagtcggaagtactgatcttagtaatctcatctgagtttacacgtgccactgcacctgtcacctcttttttacgcattgagccataacctacaacaaccacttcatccaacacttttgtgtcttcctgaagcttgatattataaatctgaccattcttgattgcagcttttacagttttatacccaacaaaactgaacactaagttacctttagtcggtaccccttgaagaacgaaattaccatccatatcagtaatagttccaagagaagtaccttcaacttgaacagctgcgcctataacttcaaggttattggcagcatcaatcacctttcctttaactgttatcttctgtgaatacatagacaatgtatagaagataagcatcacgaacaacatgtacctgccatggtaccattttttctgatttctcatttgtaaaaattttaatttagcaataggttatgaaattccttttataactgacgctaaattatttatttataatggtacaaaaggggagaattatatatttaaaaagggggtaaaattttacccccacttatattaagaatccaaatcggtctgtatactctgttctttgtactgttgcggcaatacaccgaattctttcttgaaacattctctgaaatacttcaaatcattgaaccctacatcgtatgtcacctctgatacagaataccgtcctgtcttcaacagttctgccgctctcttcattcttattgaacgtacaaaagcattggctgttactcccataagtgctttcagcttcttgttcagaaccaaggccgtcacgccaagacctttacatatatcctctatctggaacgaagagtctgtaatgttgtcctctattatctttacaagtttctcaaggaacttatcgtcggtagatgtagtgcttacctcggaaatctttattgccggaactttcttgtgttgaagaatccgcttcctgttggttataatggaattaagcagctctttcattatcttgttgtcgaaaggtttagggcaataagcatctgcatggaatttatatccgatgaaataatcctgcaatgtagtcttggctgaaagcaatactacaggaatatgagatgtccttacatcctgcttgattctctcacacagttccagaccattcatgcccggcatcattatatcggataaaacaagatccggttgcaaatctggaatcatgttccatgccatctccccatcatgggctatcattatcttatacttatccgacaacagtaatgacaacatattacatatatccttattgtcatcaacaatcaatatagccggagattctccgtccacttctatgtctatcatctcttcatgctcgcacgattcacttcttaacacatcagcaaacttttcatcctccccactgttggcagagatattctccgtaaccatgtccccctcagttatcataggaattacaacatggaaaacagtgcctttacct

SEQ ID NO: 77 - DNA, 6185 bp, Artificial sequence
  Synthetic sequence
atatagccggagattctccgtccacttctatgtctatcatctcttcatgctcgcacgattcacttcttaacacatcagcaaacttttcatcctccccactgttggcagagatattctccgtaaccatgtccccctcagttatcataggaattacaacatggaaaacagtgcctttaccttcctctgatacaaacgtaatatttccattatgtatctctacaagccgcttggtcagaaacagacctataccggtacctccttcagcagagtttttattctgactgtagaaacgctcgaagaggtgtgttttcaggttgtcggatattccgtttcccgagtctgccacagagatgtttattttgttatcctgttcattgacagtaaacgatacaaatcctccggcaggagtatgcttaatggcattcgatacgagattatagattatctgttccataagatgagggtcgaacagaaagcttatatcactgcgtgagacagaatattccagccctacacctttctgttttgcccaatacgtgaactgctgaaatacttcttttgagaaagacgagaagttgccatatttgagattcagactaagcattcctttctcgctctttgagaagttcatcagctggttgacaagacttaacaggaacttactgttatgctccattgtctgcagcatgccggcaagatacttgtcggacgaatacttgcccgattcaataatcatactaagtggagaatgaataagtgtgagtggtgtcctcaattcatgcgatatgttggtaaaaaatgtagtctccttttcaagaagttcttcagtcttgcgtttttccatgtttgctatatatagagcatttctgcgctgcacccgtgaggtataatacaccttgaaccggtataaagacaagacaagcaatataaaatagagtgtataggcataccatgtacgccagaaaggagggttaataatgacaggtatggaaagttcattcaaactgtagactccatcgctattcctgaccctcagtctgaacatatattcgcctgaaggaagctttgtgtagaaagcctcacgatgaaaagcggaggtggaaatccatgaatcatctacgccttcgagcatatattcgtaaccaaccttataaggacttctgtaatccagggagctgaactggaatgagaaagtgtttaaattataaggcaattcaatgtgctctgtaaaacttacacttttgtcgaaataagctgaatatgtggaatctgcctcaacgctgtgattgaagattttaaaatcaacgagtgtaggactaccgttgaaatctatcacatcaaagtcattaggtctaaagacgttaattccgtttacgccaccgaatatcattgttccatccgtcattactccagcagaaagttccataaattcataatcctgaagaccatcgaaaatatcataagatcttattctctgtgtgttgatattcaacgaattaattcctttattggtagaaatccataatgttccatccgtgccattaacaattgattttattgtattgctgctcaacccgtctgcagagctaaaattttcaacgcaggcattatggttttcatccaaatccacgattttccttaacccacgtccaagtgttccataccagatattatgattcaagtcttcacatacaggcactatatagtcgagttcatcaagtcccttgactgagttcaaaacaggattatctatatacaaatctgcagattccaatactttaagaccgaagctggaagctacccatatattacccttatgatctttaatgatgtttcttactatcttaagttctttattgtcagatgttttgatttccttcatcacacctgtggacaaatcatatctgaaaagacctttattatatgtgccaatccacaaatattttccatcggcaagcattgcgcgcacatttctcaaacctgagatctttttataatcattatcagaagtgaaactgtaaataccatcgtacatcagagacacatacatgcagtcggtgtagtttgagtatgctgttgagtatactatcctgtttgccgtgaaaggaataagtctggcattaccggtaatggaattaaaatgatatagccctgagccttctgtgcctaaatatatatcagatttggcaaatgtataaacggacgatatatgatcatttcctattcctctgaataaatctataggtttattattttcgcgtatactcataaagccactcttgaaaaatcctatccaaagaatatcgtttttatcaagaactacagtttgcggatagctgtaagaatatgtagcaataacctgtggttttgactcgatggcatgcaatacatcaaaagtcaacacattcacagtgcttgtagtggcataaaataatcttttgtttttatataccatttttcgtatatcacagttttccaacagggtacttaccttgcaggtatgcttgtcgtataaacataattgatgattttccagatttgagtacaatatttgagaagatgagatgactatggctgaagctatagggcatcccaatagtttgttaagcagtaattcatctccatcgacgttacattcgtacaggccgtcttcggaggagagcattatcgtattatctatttctatgatgtcggaaatgtatggtaattttaatgttgatcttaagacagtatttattttgccattttgaaaatcataatttacaaggtatatactttcatcagaggaatgaaaccagactctgtctttagagtcgacaagaatcttatcgcaagtgaaatttttatcaataccgctgtgaccaagatttaatgaaacgaattcgttctttacagaattgaacaggaacactcctctatcggctgtacctatccacagatttccatgtgaatcttcgtcaatacatactatcagattactgttaagaccgtttgactgatatccgtaaaccttaaattcatatccgtcaaacctgttcagtccgtcgttcgtggccaaccatataaagccttttgagtcttgataaatacattgcacatcattttgggaaagtccatcaagagtagtgtactttcttgtgacaaactcattggatgcaaaggatttgcaaactataatcagaactgatattaaacttaagattaatctaaacatataactattattctttatatttcatcaagattacaaagttattgattttatctaaaacatcaagtatttacagtagttaatagataattatagatattttccactttagaatgcgtatcaaaatcaatcaagaaaaaaataaatctttaacttcatttcatagtataaaacaaaaaaagcatcgtaccattacactcaataatagatacgatgcccgaaagaaattacagtaacagactgtattgggattgttcttaaaaagacttatctgtatgactttatatatatgtcgagtatttcggtatccgacagttcatgagggtccagactgaacaatgcacccatggcagttcgcgcattatcaatcatcttagggaaatcttcctttactattccccagtcgctaagcttcaaatcgcggacattgcattccttctgcattctcaccaaagcatctataaaatgttcgggattaaggttcttgcatccggtcataacatctgccatgcgcatatatctctttgtcctgtcataaataaaagtagagaaataggcctcgcttatagctatcaggccaacaccatgaggaagagcgggatagtatgcgctgagagcgtgctcgagagaatgttcggaagtacaactggatgtggattcaaccattcccgccagcgtacttgcccaagccacctttgccctcgctttcaggttatttccatccttcaccgcaacaggtaaatatttatacagcagtctgatggcctcaagagcgaaaatatcacttattggggttgcacaattggcaatatagccttcggctgcatgaaagaatgcgtcgaatccctgataggcagtcagatgtggcggaactgaaaccatcagttccgggtcgattatcgacagacatgggaaagttaaagtggagccgatacctatcttttcgtttgtttccagattggttatgacagtccatgggtcagcctcggttccggttccggctgttgtaggaatggctatgatgggcaatgctttgctgtaaggaagccccttgccggtacctccttcaacatattcccaataatcgccatcattacatgccatgattgcaatggatttggccgtatctatcgaacttccgcctcccaaacctataatcatatcgcaattttcctcacgacagattgccgtaccttccattacatggtcttttattgggttaggcaatatcttgtcgtacaccacggcatcaacattattttctttcagcagaccaatcaccttatccagataaccatatttacgcattgatgttccggatgaaatgactatcaaagcctttttgccgggcaatgtctctgttgaaagacgtttaagttcgccacatccgaagagaatcttcgtcggaatattataaccaaaaacaaaattattgtccataaatattatcagtcagtcaacttactatcttaaagcctcatcaatcactttcttgagttcaggataagcctcatctgtatcgcccacctgttttctcaactcacgcagtttctttttcatgtccttaagaactttggcgtatttaggattatcagccaggtttaccatttcgtaagggtcgttcttcacatcgtagagttcgaaagaaaccggagtaggaacaatcttgtggctgttcttcaaccatgacattgatttctgtccgtaacgtttgtcgtcgtaatgacggccatagaaaagtatcagcttatagttttccgtgcggatacctatgtgtgccggaacgtcgtgatgaatcatgtgcatccagtatctgtagtaaacagcatccttccagttttctggctttttgccttcgaacacagaggcaaagctctttccatccatgtatgaaggttctttgccaccgaccatctctataagagttggagcaaaatcaatgttgttaatcatcaggtccgacttggctcccttgtaaggacatctcgggtcgcggactatgaaaggcattctttgagattcttcatacatccatctcttatcctgcagatcgtgttcgccaagcatcataccctggtcgcctgtatatacgataatggtattttcccagagtccttccttcttgagatagtcgaaaagacgtttcaggttgtcatccacaccctttacgcaacgcagatacgatttcaggtaatgctggtaggcaaggtatgtattctccatttcatcacctgtattgcacttatattccattacataattgcggatttcatgacggcttgagacagaagttccgatgaagtgacgaagtgaatcgttcttgcctcttgtgccttcggagccccatttgtctgtatcgaacaatgacaatggaacaggcacttccacatcgtcaagataatattcatagcgcggtgcgtactcgaacatatcgtgcggtgccttgtaatgatgcatcatgaagaaaggtttggacttgtcgcgtctgttcttcaaccagtcaatagcaaggttggtcacgatatccgaggagtaacccattttctttatctggttattaggccatttcttgtcagttacgtcacttgtaaggaaaatagggtcgaagtattcgccctgtccgccatgaccgttgaatacagaataatagtcgaagtgcgacggttcgcatcccaaatgccatttaccgatcatggcagtctgatatcccatattatggaactcatcaaccagatattcctggtccggctgaagcacttcatccaaagtgagcaccttgttacgatgggaatactgtccggtcatgatacatgcacggcttggggtactgatggagtttgtacagaaacagttctcgaagagcataccgtcccttgccagttcatcaattgtaggagtagggttcagtactgcaagacgacttccgtatgcgccgatagcctgcgaagtatggtcgtccgacatgatgtagatg

SEQ ID NO: 78 - DNA, 6178 bp, Artificial sequence
  Synthetic sequence
ctgtccggtcatgatacatgcacggcttggggtactgatggagtttgtacagaaacagttctcgaagagcataccgtcccttgccagttcatcaattgtaggagtagggttcagtactgcaagacgacttccgtatgcgccgatagcctgcgaagtatggtcgtccgacatgatgtagatgacattcatctgtttctgctgtgctgcgacaccaacacatacagacaggaatggcataacagccattcccttcattatattattttttaaattcgttttcataagtcagattatcattgaaatagaacttgcaagacatatcatcgaatgattttacgtccttattctgcattttaacccattgttctgatttagccttgacagcgacctgagttgaaacctcattaccgtcgactacacttttaagagtgacatttgcatcctctgcattatggtttgccacacgtacagtgataaggcatccgttatcaaccttatcgtatagcggtttggaaaccaccgcccctttaagcttaatcttgaacacatgtgcatattcagtaggtttgttcttagggaagtttactacaagaccctcgtcagtcatcttatagtcaatcttctctgagcttccaagcatttcaaccgactcaatttccacgttctggcaatacttaggagcaaatgacttgatagtaacactaccatctgtccaagccagagacacggcatagaggttattgtcgcgtgtagtaaagcgaatgtcgtccgctgtatattcagtttttgtattgtctgtcatataacctgcggtgcctgcgttatgtccttcgaaagcaatcacccatggtcgtgagccataaatagcctcaccgttagtcttcaaccatttacctatctcggcaagtacgttcttctgttcgtctgtaatagtaccgtcggccttaggacctatattcagcaataagttaccgttcttgctgacaatatcaacaaagtcgtcgatgatatggtcaggactcttgttttcctcgcccacacaatagctccacgatttcttgcctacagaagtatcagtctgccatggatattcacggattctgtcgctcttacctctttctatatcgaacacctggatattgtcgccatatccgaatttagtgttaaccacaacttctttattccaatcaagagccgaattgtaataataagccatgaatttatagaaagtaggctggaacggatattttcccacagtccagtcgaaccatatcaattcaggctgatatttgtcgataagctcgtatgtatgcataaggaactgacggcgtgaacgttcgttcgagccttcatacttaccacaataaggtgtcataccctgaccttcgggctcatgcagtctttcgccatacagagtgattgtagtgtcctgaacatcagaaggagtttccattccatattcatagaaccatgcattctcgcatctgtgagaagaaagtccgaaacgcagaccggctttcttggtagcttccttcaattcgccgattatatcccttttcggtcccatatccacagcattccacttattgaaagtactgctgtacatggcaaatccgtcgtgatgctcggccaccggaacaatgtattgtgctccagatgattttaccactgccagccactcgtcggcattgaaattttcggctttgaacatagggatgaaatccttatatccgaatttggtcaaaggaccgtaagtctgtacgtgatacttattaataggatgaccttccttgtacatccagcgggaataccattcactgccgtatgcaggaacggaataaactccccagtggataaagataccgaacttggcatccttaaaccattcaggaatagtgtaattttgagcaatcgatgccgaatcggccttgaacacatcagtaccttttaaagatacagtagaatctacattaggagcgtatgtagaattgcacgacgccaacaggcttaatgccgcaactcctaaaaccgttttcatggatttcttattcataataatcttattacattaaataatgacattaattttttctgtaagcaaagatacacttgagttccatttacaataaataatttaattactatagtaaggggtaaaatatttaccacctattattgaacaaatttaccccctctcatatatgataataaactgccaatatcgaattacaagtaaatatatatttcaacaaaaaaggtttagcctattattacacaacaatttcaccctaagaataaaatatatatagagtaaatttgccaatataacaaactgtaaaaacaaatttatgaaaaactatttgatttacttactcgcagcagtatcgtgtacaactgtagcagacctaaatgctcaagtcagtacaaaaacaggtaatgaaaccacagaacttacaattccgaaaaagttctacaaggacagcattgatttcagcaatgctccgaaaagacttaacaacaagtaccctctttccgaccagaagaacgaaggcggatgggttctaaacaaaaaggcctctgacgagttcaaaggaaagaagctgaatgaggaaagatggttcccgaacaaccctaaatggaaaggaagacaacctactttctttgcaaaggagaatactacatttgaagacggctgttgcgtgatgagaacttacaagccagcaggatcactgcccgaaggatatactcacactgccggtttcctggtaagcaaagaacttttcctttacggatatttcgaagcaagactgagaccaaacgactcgccatgggttttcggtttctggatgtcgaacaatgaaagaaactggtggactgaaatagacatttgcgagaactgccccggcaatcctgccaacagacatgacctgaactcgaacgtgcatgtatttaaagctccagcagataagggtgatataaagaaacatatcaacttccctgccaaatactatataccattcgaattgcagaaagactttcacgtatggggacttgactggagcaaggaatatatccgactatatatagacggagtactgtacagagaaatagagaacaagtactggcaccagccattacgcatcaatcttaacaacgaatcgaacaaatggttcggagccttgccggacgacaacaatatggattctgaatatctgatagattatgtaagggtgtggtacaagaaataagaaataacataatctgaaattataaaaggcagtcttcattatcagtatgctgatgataaagtctgcctttttaacaagaagataaagattttaatctgccctatcactcatttacttcatccggatactctgtaagcgagtttcccgaattgcttatttcaatagagccgataggaagataattgaacttcttgctccatgcagagataccataatctcttctaagaataggcatcatgacctcctcggcacgtcctgagcggacgaggtcaaaccatctgtcaccctcgcatgccagttcacaacgacgctcataccatagaacatcaattacgcttttaaatctgtcaggatacatctgcattagcttgtcaacatcaatataacttccgtcgtctgcatgaacatgcttctttctgagttcatttatgtaatacttcgcttttgcttcatcaggattagtacctctgagatatgcttcggcaagcatcagatacacttcaccatatctgatgacccttacgtttccaggcttgtttagattggggtttcctatcatatcgtaatttttgaaaggaggatatttcttctgggcatatccctggaaatcaggcccgtaagagcctgtctcccaaacaactttttttgattcatcctgaatattggcattaggtttggttacaagttcatcgtaagtaaatatcgccgcatcacgacgcacatggtcatccggaaggaaataatcatacaattccttagtaggcagacaaaagccatatccattatcataatcaggactatttttcaactgtctcggtccgcagaaagtcacccacatagcaccttcgcctgcatcaatattaccccagtttgtattaccagatttggtagaggtctgtatttcaaatatagattcctcgttattctcctgatgagccgcaaacaatttagaataatcatccgtcagagtataattaccacttgaaattacatcctccaataaaggtttcgctttgtcaaaaatcttagcatcatcgttgctccagtcagcccaataaagatagaccttggccaacagggcttgagccgcagtcttggtaatacgtcctttcattgtgtccgggaaattatcctttagagaagggatagcttcaagaagatctttctctattgctttatttacattttcgcgagtatctctcgtaaacttgaatccttcaggataaagagtctcaagactgataaagcatggaccataatatctcaacaattcaaaatgataccaagcacgtaagaacttagcttcagctttataaactttagcttccggactgtcatactctgaatttattacaagattacatctatatataccacggtaacgagttttccacaaattatcggaaatagaattgacactcgtatttgaataatcctctatagcctgcatgtaaggctgatcctgatcagagccaccaccagtacgagcattatccgaacggatttcacccataggtacaatggaagcaagtgcattacccgaagcaccacctatgtgagctaacggatcataacaagcagtaagcgctttgaacatctgttcatcggtcctataaaaagaactttctgtttcggacattataggagctgtatccaggaaactgtcgctgcaagatgatgatgcaatagcagcaaacatgaggacaagaatattattatgtattttcgacttcataattttcaattttagaaattaagacttaaaccaaatctgaatgtacgggcctgagggtaagtaccatagtcaatacctgtgctaagaatattgccacctgccatatttcctacttcaggatccataaacggatagctggtgaaagtggcaagattatcaattgctgcataaattcttgctttattcagcatcaacttgtttattaatttagttgggaatgaatagcctacctcaagtgaagaaatctttaaatgcgaaccatcataaagataaaaatcggatggtttgccaaagtttccattaggatctttggatgaaagacgaggcactccattatcatcaccttctttccgccatctgtcaagatagaatgatggaaggttgctgcgtccgtatgcttcctgtcggtaaatatcagagaagactttatatccagcttttcctgttaagaagattgtcatatcaatacctctccagtcggcacctaaattcaaaccgaatgtccattttggccaaggattgccacaatcggttctatcttcatctgtaatctgcccatcgttatttgtatcttgccatataaagtcacccggaacggcatcaggttgtatcactttaccgtcttttgatttatagttctgtatctgctcttcattttggaatattcctaagttcttataaaggcggaaataacccatagcatgaccttcctccatacgcgttacattaacagatgttctccagctaccaccatcagtatatccatttacatttcctatctttacaacctcatttttaagatatgaggcatttgcggaaatagagaagttgatttcgttccaatttttattaaatgtcatctgcatttccacaccctggtttgttatattaccaaggtttctaaaagctgcattattacctctaatggcttcaactgttggctggaacaacaaatccttagtactttttttaaaccagtcgaaacttgctctaatcataccattatagaatgtcatatcggcaccaacattaaattgttcagaagtttcccatttcacgtctggattaacaaggttattaggagcagatcccacagtgatggcattaccaaacgtgtaattataattattgccaataatagaagtataggagaatggagaaattcgctcatttccgttctgtccccaagagaatc

SEQ ID NO: 79 - DNA, 6162 bp, Artificial sequence
  Synthetic sequence
gtgagttgattgctacgtaaataacttcgtatagcatacattatacgaagttatggactacgcaggtcaatatccggaacatgaaacccgcaggttctgaaatccgcatattcagaacatggggattcgggaagcgcagcaatacgggcagtctcaggttcgatgctccggtcaggaaatgggaatacagagaaccgaatccgttatatgacggttacaccacccgtaactggttccgctatcatatcatgaaacaccgggacagggaaaggacaggcgaatacaccttccgcagcgattcattcacgctgtacagccggagcgagctggacgagctggccgcaatcctgaaaggcagactctacaagggaatcctgcctgactctcttgtactttggggataccgcatggatattaaggaaatatcacgtgaacagtggaacggtatgggacagcacggacaaatccgcatgaaattcatgggatacggtccggtcagaatccacacggacaatgaaaaccataccgtaacagtatacagaatcaacgacatattgtcttcaactatcagaattttcatattttttcagttctttttttgtttcttctattaatattttaagccactccatgatttgtattgcatgttcatgaacagtttcattttggctatcactgtcgtgtagtagcctttgaaaatcacgtaaaatattgtctttcccaagcatctcccatacaggcatcatccggtggattatttttctcatggtctcacggtcggttatcctgtcagcagattccatctcctccagttctttttcagattccataacaacgagagaaagcatatgactataatcatccgtattctccagtaaactggaaaaatcgaattctccggaaactgaaacttgtgtacgagatataatggtggataaaaaagcaagcagtccgtggatattgaacggtttatgaatacagcctacaaatccttctttttcataaattccggaatttccgtcaccacgggcagtcatgactgctactggaacagttctagaattgccgatgtccgaattgcgaagcaatcttaacaaaccgaatccgtcagtatcaggcatttgtacatctgtcaagatcaaatcatattcagaattttcaagagcggccactacttcacgtgcattcttacaggttttacaggatatacctttgcgcccgagcatatcttccgctattttcagttgtataggatcatcgtccactacaagaacattcttaggcaatatagttattgtattatggtccgatttgtcttcctcaactaactcatccgtttcaggcaaagaaagttccagtctgaacatgcttcctttaccgagtacactttctacatccatttttccttccaaaaccttaattaatcctttggtaaggaaaagtcccaaaccaaacccttcagaattgacattctgtgcggcacgctcaaatggagcaaatattcttttcagtgtttcctcatccataccgataccagtatcccttatttcaatacgaagttttccttctgaatattctgaatggaaattgacgttacccctggaagtaaacttaatagcgtttgtaagtagattggctaaaacctgttcaagtttgtccgcatcaccttttactattacatttgatcctttatgttcagaatataaaatcagaccttttgaagtcgctttacgagaaaactcatctgaaattcgttgcaagaaacggtcaagataaaatggtgtgtcgttacgcaaattaccggcttcattgattcggtaagcatccatcaaatcattaaccagatgtaaaacgtgtcgacaagaatgacggatgtcatctaaatatttttcgcgcttcctcttttcacgcgtttcagataccaaatctgcacagttatggatattaccaagtggacctctaatatcatgagaaactgtcaggatgattttcttacgcatatcaagcaaattctcgttttcttgaatagcttgttgtaatttaaatttaattatttcttccttacgtaaatctgattgtataattaaaaatgaaattaatattataaaaaccgcaatactcatcattacgataaataatcgaaaggattcttgtttgacttccgttacctctaagtttcgttctataaatgacagctgtacctgattatctaaaaaagatacaaaatcatataatttttgatttaacagcctattctgcaaacgcaagctatccacataagtttctatctgattgtttcgcatatctatgacagaaaccaatctattattaaaattctgtatttcattagttatataggggacttgtatcgtctccttctttccgaataatccggcaattcctttctttttctgagttattgtcttcacttttactgtttgagtagctattacaggcaattcattagtaagaatactatcagatttattcgcaaattggactgctttcattatttgaaacaagtgcatttctttcgttttaagcaattcccgtaaagaatcaatttgaactggacataaaaaatcacaactccttaattttatttcaagtagaacactatctgttttaaaacgttgattatgaaatatgttataatcagactcatcccatactataactgattcgcctaaagttgccaacttagtaatatacaaatgaactttattagtattctcataagcttcattaatttgaattatcagattctcaagttctttcaaccggcaacgttcatttatcattacagtaaccatacttaagactataaatcctgtaataaaatatccaataaatagtcttttgcgtaataatgaagtcatcaggaacattctattgatttatttgacatcataattctatatatttaactagtcatagtatatatcattctcaaatatttatttcaaattcaagcaataaaataaaaaaacacttcatattacaactgaactcttttatgaaaaagttgaatatatgaagtgtttttttattacgatataaactataaaatcctattcttcgggaactggtgtataaacccttatccagtccaccaggaaggtgtggtcttccacatttttcagttcctcatccgtagggcttaaacctttaacggctctccagctttggtcttccatatttattatgatgtccatgtcttttaccagacctgtaccaccagtgtagttgttggggtcgataatatccttgccgcttacggttctgacaagttctccatctacataatattcaagtgtgaaagggtctttccagaacactcctacacgatgaaaatcgtcgcgccacaatgttcccttgtcatccttataccatgagccaagatctttcggctgataatccttgaatggctggcggatgaatatgtgatggctcaggtgaagtctgtcggcaccgtaacctccgccgtctctgtcgccgccgtatgcttctatgatgtcgatttcctgagtatcgtcagggctgagcatccatacatcggatgccatggttgaatttgaaagttttgcgtatgcctctacataaaccggatactttacacgtgtcttcgatgtgatacatcccgtataggttcccggcagttcctttgtgttgggtccgcttacaactttcttcatggggacatcttcaggacggctggctcttattttaaggtatccgtcggaaacggaaacatggtctctctgccatattgtaggagcaggtcctgtccaatgattatgatagaaatcggtccatttggcatagaactcttttcctttatccttttcgtcggcaacataattaaagtcgtccgactgtggatggagtttccacaccataccgtcgccggcatcagcgggtacaggatagatatcccactcgtacgatttattattgaaatcttctgctgcacaggctatttgcagcgatgctaaacaaatggtaaacagttttctcatcgtggtatcttagtttaagttataataattattttcgttcttttgattcacctttagcggtatgtgtctgcaatgtccaggtagaaaatctcattatgctctgatagtctgaactgttgtatatatgagtaagaccccatctcaatatttcggtaggttctttttcggcatctgcactgcggttcaggccaatggcgtgtggcgcgccttttactactgacattatttcaaagtttattccgtcaggcgaccactggagtgtgttcttttcaggaccgtcggtggtgataagtgaagctatacctcctttgtaaggccatacgcaaacttcatgcccgctgtttgaaataggattatattccgatttcacatacggacccataggattttccgcaatagccactccgtgtttgatttcacggccgccccatgttatttcttctcccatacgttcgcctttgtagtacatatagaacttacctttataaggtattatacacgggtcgtgtaccttatgactgtcgaaatcacctttcgacactaccttgaatctgttatcctcatcgccttcccattcgccggtattagaaggttccagtacaggcttgtctgtcttgatccacggtccttcaggggaatcagcacatgccataccgatagtattctttacacggactgtgtaaggggattttaccgcctgatagcaaagataatactttcctttccattccatcacctcaggagtgaagactgaacggtcgtcgtaagcacctttttcaccacgtttcactgcaattccctgttccttccatgtccatccgtcttttgatgtggcataccatatatcacatctgtcccatgggaaaaccttatctttctctatatctccagcaaatccttgggtaggtccatagctctttgaataccatacataatatgtattacctattttcagcattgcactcgggtctcttcttactacgccctcttcataagcaagatcacctttaagtggttccatcttatactcaaagaaccatttattgtcgtgattttcccatttcatggcacgtttcatagctgcacttaacttatttcccttaggtattcccaatgaatcggccttacgctcatcataattctgagtgtcgtcaacggcaatagtctgtgtattgcctgtatttccgcatgctgccaatagcgacatcatgccggctgcaagaataatttttctcatactagactttattttatattaattgttagtttattcgagtgtaattcacttgtttctgcactgatattcagtaccgatgatttttctgtcgactgaagcatcagcatacatcttccctgatatgtcataatatccttactttgatatggagaaacgttcttcacgtttccattgtctataccaagcagacggtactctccatcaatgttgaacttaagcatctgttctgttgtctttacaggattaccttttttgtctgttagctgagctgtgacatgcagaacatcctttccatttgctgcgatactttgtttgtcaaccgtcagcaatatcgaatgttctttgcctgaagtccttatagctgtagtggtattacctaacttattttttccttttgcggtaatagtgccaggcttgtactgaactgcccatttatagatatgatcctcaaaatcgtctatatacttctttcccatcgacttaccgttaacgaaaagttccacttcatcacaattggaatatatctctactattaccgagtcacctttctgataattccagtgagagtttacatcatcccaaacccataattttctatcccattcatgtcctttcttatcagtaaatccatcttttacatggagatacgaagatttgtctgtagtctgtgaatatatagcaataaaaggcttgtctgtccacaatgatttcatcatgtcgtacgaaggcttcacatagccgcacatatccaggagaccacatcctatcgacttttgaggccattttgaaagacggctttcactttctcccagataatcgactcctgtccatataaacatacccggaacgaaatccctttcaatcaccgccttccattcgtgccactgaccgagattttctgtaccc

SEQ ID NO: 80 - DNA, 6138 bp, Artificial sequence
  Synthetic sequence
agtttcccatttcacgtctggattaacaaggttattaggagcagatcccacagtgatggcattaccaaacgtgtaattataattattgccaataatagaagtataggagaatggagaaattcgctcatttccgttctgtccccaagagaatctaagtttgaagacatcaaagttcttaattttccagaatttctcatttgaaacattccaacctaatgaaacgcccgggaaagtagcatatctgttattgggaccgaaatttgaagacccatcgcgtctgaccacaacttccgccatatatttttcagcataattatagcttagacgagcaaaatatgagaacatactatgtctaggattagcaccgccactattagctgatgtcataacatcaccagcattaagataccagtaattctcattggtcattgcttcatttggatatttatttcgtgttccggccataaactcataaacatctcttgatgcagaagtacctaacaggacagatgtagaatgttcaccaaaagattttttatatcgcaatgtattctcccactgccaactactattagcatttgtactttgttctaccctagaattatcttctttacattctgcagaatgaaaaaactttggtgcaaacattcttccacggaaattccgatgattaataccaaaatctgtgcggaaaacaaggtctttaataaaagtgatctcagcataaacattaccaaaaaattgctgggtaatatttttattcttaggtgcctcatccataaatgcaatagggttccacatacggctataaggtacaggagagactccatatccgaaagtatcgttgctattctcatcataaaccggagtagtaggatcaatattataggcgtatgatatcggattataaccattgataccggttgccactccactattctctatatatgcatagttgacgtttgcacctacacttaagaaatcatttatagaataggaactgttcagccttgtgctgaatcgtttgtaaaatgacgcatcttcaccgataataccattctggtctagataattcaatgaaagcaagcttgaacccttatcactgccaaagttagcagtaatgttatgctcagtaacaggagctgtattcaatatttcattaaaccagtctgtattataacctgttggagcagtaggtacaccaccggcaagcggcatatcatcattgtcggcaaactctttcatcagcataatgtactgttcatcattcagcatggttggtttctttgctactgtagagaaaccatagtaaccatcataagcaagcgatgtctttcctttctttcctttctttgtggttataaggactacaccattagcggctctggcaccataaatagcagctgaagttgcatccttcaagacttccatgctttcaatgtcgttgggatttacactgttcatgtcgtccataggcagtccgtcaattacaaaaagaggattagagtttccatttgtaccaacaccacgaattaccagcttcggtgctgttcctggctgaccggaatttgtcacaacgttcacaccactaaccctaccgctcaatgcattcacggcatttgctggtttagattgcaataaatcatcggaatcgatgctactgatagcacctgttacaacactttttttcttaacctcatatcctattgctacaacttcctcgagtgcaatggcagatgtttttaattgaacgtctatcttagactgacctttatacactatattctgtgtatcatatcctacgaagctataaatcaatgtcgattccattggtacattttccaagatataatttccgtccaaatcagaaataataccgtttgtggtacctttaactaaaatacttgcacctatcacaggtaaaccatcggagtctgttatacaaccggtaactttcccgttctgtgcatttaatggtaaactgaacgttataagaatcagcatacacattaatgatagtgttctgttcataatctagagttttttgtaattagtgtttttcttaaaataaaaagttttgttctatcagttgcgcgctacttactgacacttgcaaatatatatactatgtaatataaccaaagggggaaaatttcatttaaataggggggggaaatagattaactaaatattttaaggaaaaatggctgttagaatccattcccagactccaacagccattttatcactaacaatcgcctgttaatcaatatatttttctgcccatttccttaagatttgcatccctgcccagtggaacaaaagtaaatccgtatgaatagcttcccttcagaagacgcttgtctattgaaggacgggctttcagactccagctatctgttccgcccactccagcctgaaccaggtcgatattaagagtattagaatacaagtccttttcaagttcatttatatgtttagccttatcaatcgcattctgcgacatctcccacactgaaacagataggggttcatcgccgacaatcatcacacctgccttatccgactgcaaggcaaaccatctcacgtcacaacggtttccgttttcctgcggcattacatagtcaaatcccagagcggacaccttgcagttatatatagacaccattgcagaggcttttctgtcggaatagttttcccatgggccacgtccataatatgtcacatccgacaaacgattggtacattcgcattgcaatcctacgcgcaacatttctgatatttcaggagacttcatcattgaataatgaacgcctattgttccgtctgcttttactttataattcaaggtaagtctcagtctttcatctatagcctttagcaccttaacctcaagattgccttccgatttgcgtacatctatagaaactgtctttagctttaatggagcatctttccagaatgcaaacagtctatcgaccttccatcctcgccagtcattgtctgttgacgctctccagaagtttggtttcagagcagatgtgatgatactttcattatctatcttatactgactgatataaccatcactgatattcagataaaagttctttcccttcacgctgatgtctttcttgttatctgaatcgatttccatatccaatgtagtatcaacgcattctactatctttggtaaagaaagatacttaaactgttcccaggcaacctcgtatccagctttggcatacagattgtcattcttgagcctggcactcaggaataaccaatattccgcaccgtcatcggccttgaaattctgaataggaagttttagtttacagctctcaccagctggtgttgtcggcacaataatctcaccttcctgcaatacactgtcttcgtccttcaattgccaaaaataacgatactcatctgttgaaaggaagaagtttctgttttttacagttatctctccactatagacattatcagttgtaaatgatacaggagcaaacacgtacttgcattcctcagtagcaggtttaatggagcggtcggcactgataacaccatttatacagaagttttggtcgttgtgctcccctttctcatagtcaccaccataattccatgatttcttattatatttccgttcattatccagcaatccctggtctatccagtcccaaatatatccgccggcaagcgcatcatgagaacgtattgcatcccagtattctttcagcccgccggtagagtttcccatagaatgtgcatattcacacattattatcggacggttcatgaccggattcttagtcattgctataagctcatcgaccataggatacatacggctaatgacatcgacgtataaaggatcatcgggattggcatacacacaaagctctttctttgccggtttgacatcttcgttcacattaaaatctatctcactagtaacgattgacgcttccttacgtccgataggtttgtataaaggattttccggctgtccttgcgccccctcgtaatgaacaggacgggttgggtcataatctttcagccatcctgacagagctgcatgattagggccgcatccagactcgttgcccaacgaccacataaacacagaaggatggttcctgtctctcacagccattcttaccactctctccatgaacgagttagcccactcaggcctattggacagataccccctttgatgatgagtttcaagattagcctcatccattacgtatataccatacttatcgcacagttcatagaaataagggtcgttaggatagtgcgatgtacggactgtattgaagttataacgcttcataagcagaacgtcttcgagcatctcatcacgtgtaacggtcttacctccggtctcgctatggtcatggcggtttacaccaatgagtttaataggagtgtcattcaccagaatctgattacctgttattttaatatccctgaaccctaccttattacttctcgcatccaccacgttgccctttttgtctgtgagctttataaccaaagtgtatagataagggtgttccgaattccatagttttggcttagaaacaattccctccatcattccgtaataaacattatcacgctgaggataaggttcgttcaccacataatcggcagtaacggtaatgtcttttccaaacaccggtttcccatcggcatcatataattgggctgacagattccatcccttcaaatcatccatattctgatttgttatttccggacggatctgtaaccgtgctatattcttccggaaatcgatgcgtgtccttactccataatcatatattgccacctgcggaatggacatgatatatacttcacgatggataccagccattcgccagtggtcggcatcttccatataacttccgtcggtccacttatacacttgcaccgccagtttattctcccccttcttaacgtattcggtaatatcaaattcagtaggcagacaactgtcttcggaatatcccaccttctgtccgtttatccatacattaaatcccgaatagacgcctccgaaatggagtataatcctgtcgctcttccacttgtcaggaacaacaaactccttgatataacaccccgtctgattattcctgtcaatatatggcggacgagcagggaaaggataaatagtatttgtatatataggatagccatatccctgcatctcccaacatgaaggaacaggaatagttttccatgatgatgaattgtactccactttataaaaaccggcgggagccaatgccatatcctcggaaaagttaaacttccattggccgttcaacgacatatactccgatttctctctgtctccatccaaagcccaatccactctccggaaagaataagtagtactgcgggaaggcaaacggttaattccgtttatggtctgatcctgccatacattctgattgtttctccactgattggcaccgttgtccgatgcagacagaaattgcatcatgaaaaataacacagaaaatgaaaaaatagattttaagttcaagttcataaattcgcattttaagtttctatgcaaatatataagtataacgaacaatgaatagggggtatttctatctatatagagtggtatttttacatatgagctaaaacttaaaaaaaactgtcagtattactatgctatgtagcactctatatgaaaatattatatattcccaagtcaaaagccttttcaaacaatttttatatattctcatcctatcccttccatcaaagataaattccaatcctgatttgccagccgcatttattccttttttcaggagaattttctttatggctatcgccatgaaaattcacctgaaaaagaatgcggcggcaaacggattagaattaaagaaaagattacagggattaactgcgaccgacgtgacgcatagccgtaattcaaaggcggctatccttatattccatatatgacctcacaaatactgtgaaaatccactttccccaataacaaaacatagcctgccatatcaacacccaaaaaacaaatactttcaggacgatgtaaagtcctgagaaatcaaactgaatggatagataaat

SEQ ID NO: 81 - DNA, 5359 bp, Artificial sequence
  Synthetic sequence
gtgagttgattgctacgtaaataacttcgtatagcatacattatacgaagttatggactaggtaaacctccccgatgggtcggaaaccgacaaatcggacgagagaatcagtccgtcggccacttcaatgccacgccatagaatcatgttctgtagagtagtactgaaatgaagctgagcctgaacatttgctgacaaaaatataaatacaggaattaacagtcgctttttatacttacaggtatccaatgataatatatgtatcatactcagagcagtagaaaatcggttttaaattattattatggatttatttgtcgaaatactctataagattataaacattccagttaatatccgacatgtatttggtcaatgatgtataaggtttatagttataatcgagcatacctttattgcaatcctcatcatccagatacttgaagaaaacccatcctacacaattcttggcttcgagcagtcccaaggtaaaatgctggtaagcgaatccacggttttgctggtcgcgtaccacgaaaccagctccacttgaattgtcaagcttagtatcctcacccttggtatagaattccgttaccatgaaaggagtaccgcccgcctggttcttccagccatccatgtagcctttttcaggcgaccatttactataataatttatggaaatgacatcacaatattttcccgctgccttaattatataactgttgtatttaggaaggctgtgcaggcgtgaacccagataaagcaattcaggatccttcgatgccttaaccgcattctttatggcagaataatatttttccgcacaaataccggcaaactcattgttcagttcatccgttacatcagaaacatttgcactcttgtccttatccgtcataaacttggcggctgcaatataagcaggatcctgcttgtttgaaattttcaggaatctgtcgagcagcctgtttccccatgtagagaagtctatctcattatccgagaagaatcccaacacatccgggttgtttctgaacatgccgaaagcatccgaattgagatactccttgcaccattcatcccatccatcataaaacacaagacctatcttaagattcacgttctgccccggatagctaattcccttgctattcttgaactctgcaaggaatgaaaaggaaggagcctgtgtcagaggacttgaagccgatttattataatcatttacagccttgtcgccttcttccttaccgaaagcgcagacactatgaaatcctatttcagagaattgtttctgcgactttgccacccagtcatctactgaactgtaaagcttgccgaaagctgagctgttgccatccattctgaatgaggcgataccccttacataatatggataaccttcggggtcgactatccaacttcttccatttgagtttttctcaaccctgaaccgtccagtagccttggatttttgcccttttgcgtatgagccatatttattcacgctttgcaaatactcatcctgtgtttttgtctgctgttcataaccaaccaggtatggcaatatccttgtctttgcctctataaaagccttgtcaggtttttccgcatactcgacaattatcggttgatactgcttggtgctattaggataggtttcagcaggaccgggaacaggcagttgcagttctacatcatcatcgtcattatcgcctgcattgtcgccgggagtattatagtcctccacattccccggttgtgagtaaataacctcaggcggaatatatgagaactcctcctgagggtcttcacatgacaaagcgaagaacggaacactcaagcaaatggttttagtaataatagtagaatatttcattgttgcaaatatttagtaaattaatataaatcccatgtcctgattgtatccccccatcggtggtctatcgggaactccatttctccccatgccttaacagaagtccaaggttggtcggcatcagtccagaatgggtcagaggcaggcaatcccaacggaaggaatgcaagtgtagtcatatacaggctgccattgtttgtataatgattcgaaatgccagtctgatgtccgcagaatcctatggtgaggaatccgccctcattgaagttattgcccgacttgaacatacgtttcatacacgctgtcagcgcacatctcacctgtgctttcgatactcccgccggcaactcattataccatgctataagagccagtggctgcattgttgccatacggtaaggtatagagcgtccgaaaacagggaatgttccttcaggagatatgaaacgctccagaatcatggcgaacctctgtgccctcatcaatgccctgtcatagtacttgcgatagtcgaaacgtgtcctcacgcccgattccattattgcatgtatagattcgagatacataggatggaacacataactgctataataatcgaatgcaaagtgctgtccgtctgcgtaccatccgtcgcctacataccattcctccaccttgcggaaagtagaatttatacgatatgtatcctgtccggcatcaattttggcaaggaagctttcaatggtggccgagaacagcagccagttagtgtaaggagggtcaatgcgtcggagacctttgaactcttttatgtagcgttcctttgttgtctggtccagcggtttccacagctggtcgaacgcgcgcaggaaactttccgcaatataggcagcatcaaccagtgcctgaccatgaccgttccacaacagataatccggactattagggtccaccgcatttgcataactcttcaatgcccattctttcagttgcttgcgctgctgtccttctgctgtatcatcgtcaggcaggctcaaccatggagctataccggccatgagacgtccgaaagtttccatatatgcaaccttcttgttacggttatcccagtttggacttacctcaagaatcatatttttctgcagttcccctttcgccatattgctcaacacaggagcagccatcctgtaagccatatccgtccagtattttcttgtctcgttgttgtttgcctcgagataacgcacatactcgcaagcggcaagaaggaatgcgcctaccccaaagttggcagtcgacttggcgtcaaccacctgtcccggaatagccttttcaccgattggctggacataacccaccgaccagtctttctgcagtgcagtcttggtaagatatttccatgctttccccactacaggcataaattcatccttgtcaagataaccgttgtttatcccccaaagcataccgtaagtgaagaaagcggtaccgcttgtttccggtcccggagcatgttccggatccatcatacttcttgtccagtagccctccggctgctgcagacatgcaaccgcctttgccatacgcacaaacttatcctcgaaaaaagacagatgctcataaccctccggcaggtccttcagcacctttgccagagcggcaagcacccatccgtcgcctcttgcccagaaatccttctttccgttcagactcttatgcttgggataaacatattttgcgtcgcgataatagagtccttcctcctcatcatacattattgagtccgacgtacaaagatattcatacagtttcttaagataccggtgattatgcgtaatcttatacatcttcgtcattaccggcatcaccatataaagtccgtcgctccaccaccagtaatccttacgcggtgtgctcatctggtactccatgacttcgcgtgcacgcttgattttataattctccggcatgacgttatacaagtccgcataagtctggaagcacacctgataatcgccgaacagcacataatcatcctttaccccgtatttatacttccattcagatttgttgttgcttttcgcacccatccactggttatactcagcccatgcctccgaatactttctgtattcttctttcccagtaaggaaataggcttccatattaccggtgtgatatgccgcataatcccagaaagaccttgcttcgggggcatgatttttctgccaggcatcgttcactttttcaatcatctccctaacttgctgagcctcagtttttttttgcgaaggaaaatgaaggtaaaacagctataaggatgtataacatccagtagtatctataacagttcatctttgtgatattgtttacattttctaaaacgaaatggggaagaatatatattcctccctcatttcacgaataattgtattattatatttatttgttaggagtccattctgctccgttgttgaaaccttctgttgtagagtcaaaacttgcatctgctcctgtacttggtctttctgtaatttcttcaatcttaaaagaagtgattttagcggttccagtagcatcagtaccaccagggacattagtctgtacagttaaaataacgttctcaagaaccggccacacaagtgaaccatctgctcttgaagctggagtttcagcagaagtagaactactgattgtgaatgtatttgtataggttccacttccggtatttcttccaatccagaatttatatttatcagatgctcccaatctgaatgttgttgcacagtcgttagatgcgtatgtataagtaaatttgtaagtacaaccatcacggaatgacattgatttagtaactgggaattgattatctgctggaacaatttccaattctccacttgcattaattttttcggcaactccttctgcaagatattccttaactgcatctatgttagcgaagttaaaatcaaaagcatctgcatgagtcaaagcaacattggcagattcaatcttgatattagcatcttcgttgttttcgtttttagcagtcaaagcactaacagcataatcagtgttataacttacgctaatatttgcgtcattactataaatcttatcaccaagaataagagtcatagtagttccattcacagaaccggaagcaacaggaattgtttttcctgctactgttatggtaaatgctttgttaacagcatcagtgaatgttccagaaacttccttatcgagtgtaagttcaattcggtcattacctgttgtctgatcaggaacaatttctttagctgaagaaacggcaacagtagtttgtttttccaaatccacaggaggttcaccgcctccttgatcatcattcaatactatcgttacaatctgtcctttagtaactataaggttttcaccactgaagttataagttttagtaccagaatttcttgtaagttctaaagtaaatccatcggtaaatgtcaccggagctac

SEQ ID NO: 82 - DNA, 4638 bp, Artificial sequence
  Synthetic sequence
gtgagttgattgctacgtaaataacttcgtatagcatacattatacgaagttatggactatttagaacatatttttccgatttgccagattacaatcacaataaataaatcaacaactaaatctaattacctaatcttataactaaaccctcaaacaatgttatttaaccttttctatcttgacatcatcaagcaggaagcatccaccattacctgaacccggaacagctgtgaaacgatatacaaaaccattttcctgcaatttgaatttaactgttgtaagattgtaattcttacggtctttcttgacctcagcagtggcaatttcttccagtttctttgaatccggattatagtactcaatcctgaagttaggtttgtcaccccaactgtatttggtataagctgaaatctgatattctgctccagtttcatagctgatgtttacagcctgccacataccaaccttcacctcaacagcatagttgcctgaatgtgcctttttcgcatcaactattttgttatctttcttttcccagacattccatgatgtcaagtcacctgactcaaaatcaccgttcttaatttcctgagcgtatgcagaagtcatcatcattccgcaagccatcattgctaaaatttcttttttcattttttctaaggtttttaatttaagtattatgttgtatctattaaaatcactcttctattggaaccaacttataagccctgacccagtcataataagtagtacttttgtccttatccttcaagtcctcagctgtaggtacttgtttttcccaatcgtatgtttcagtaactatatgtatgaacataggtcggtcaaacggagtatctgtatattttgttgtaggcttgatagtgtacatatactttccgtcataatagaatttcacggtatttgcatccacccaccaacaaccgtaagtatggaaatcttctgccgatgggtccgtcatatacgaaaccacatccgaacgtttcgccgtattgtcagtacgtttgcctccttgttcctgataccaatagtgagtattactgttcatctgcatattccatgtcttgttccacggattatcagggttgacacttcttattatacccattgtttctataatatcaagttcctgactgctccatgtctttatcttcttgccgcctttcattatttccttcattaccgggcggttggaaagccaaaaagtagacgacatggtagtgagcgaagccttcatccttgtttcataatacccataatgtgcctggttctttgcagaagcaaccgctccaccggcaagacgatatttatcgcccggctttccatcaagtccttctgttggcgacaaaacggtattgattatacgaagacaacctttcttgacactaacattctctgccttgaaagttgcaggcggccgaccgttagtccaataaggacttttagcatgccatttagcggcattaagacgtttaccattgaattcatcagtataatcttcgttaactacccatttataaccctcaggagcctcaggcaaattttttatatgctcttcagccaaagaatattccttatcattttttaatgtataagatgacaggaataaagatgcagcagataaatacaatactgtttttctcataaactttgtcgttttagattttttgttacacgacaaaagtatataagtttcatgaaagcattaagggggatttacatcgtaaaaggtggggtaaaattctaccactccctgaaacacaattatttcactcatgaaaccatgtgtttttacgatatataaaacccgacagaagaataataccgtattaccggctaatttacataagaataacttttcaaaccgccatataccccactttacgtccgtaccctcagtcctcgactccggcaatatgttttccatatcgagatctatggttttctgcctcggattcaaccactaactgtcgagcatgtggattgcgtatctgtcatagaatctctttccgaaccatattatctcgtctgtgctaagtatgttgttcagacggataatctttccggtattttaccacctacttctcttgcaaatcctgatctgatataaccggatactctcaattcattgatttccgacttgtatacagtctgcgaagaggcattgaaactactgcacagactgaacagcagcaggggaataatttaactgattttaatagtagacattctgtgttcataatatttcattttaatgattacgtttctgactttcgtctgatgcaaaattatgaggtatcggacggggttgtatctttcagtaaaaatcagtaaagtcttggcaaggggtaaaaaacttaacatcttgtatataaatatattacaaacaaggtgcaaagattttcagtaaacgatggcgaatacagaacctatatatttacacgccataaaatgaagaaaaagcagtaggaaaaaaatgcgggcaagttccggataaaatgtgggcaagtttaaggtaaaacttgcccgcattttagatagaatgcgatcgcatttaaaacaagtaaaaaacgaagaaaaaaaatatgtgttcttcacagaacacatatttcaaaaataggtataaacacgctaaacaatgttaacaaaatctatttataaaaaaagctcacatcaataatatctgcaacatttttacaatactccataaatgaagagaccttgggatgatttatacacagagctatctgtgatgtaggcgaaaaacgtcctgtcccgtcaagaaacgctgtaagctcagatgggaggagtatactgccaatacctggatttacgtcagtcagaacgactgtatttacagcttccaccgctgacacatcaagataatcgagtgccggaagatctgcgaagtgcaattttcctatcatattgccgcctttgctgccctgaagagagacactctccaatgaagaacaaccggatatatggatttcactgtcgaatattgaagtttcggaaacatcatcattaagtataacagaaggaacaactaccaattgaagcgaactgttattctccaccctaagtactttcaatgatgatgcggaacttaaatccattcccaaaggtgtatcaatattagagattgaaaatactgaaactcccgaagacggcttgacatacgacatggaataatgcttggacttcactcccgaaatgtctacttttcctctgaaaccgggatttgacaatatatactccacaccctcaaggttagctgtctgcgacaggaaaatgaggtcgttcccttcggttatcctcttcgtgacatcaatctccaacgatgagacaaacaccgacgggaagtttctgtaaagatatgaacggagcaaaggatccggtactcttcggtttactgtatattcagtgtaatttccatcctcgtccgacatcacgacaagacatttgtccgtcatggctttatagaatgcaggtatgacatctgtattccattttgcaaagtaaggaagtttcagatttgtaagacttttacaaagcaccgtagtgccatcggttgaaataagattgagatacgaagttatgccgtcattgccgcgtaaagctaccgattttattccttcgggcaggtcagcaaagtcgaatatagaaaaactgttacactcaagattgacatctgcgagcgaaggaaaactcctcaaaccgctaatagatgtaagttcgcatctactcaagtccaaagaagtggtattgagaacttgattgtcacaaatcagctctccgttttcgctgaaattaaatcctttccgggtcaagacatcgcgtaactttgtatcaaaagtcacttcagacacttcaaagtcggaaatttctgtttcatccttacacgagattattgtgaaacagagaactatcagtacataaaagctaataaaattcctcataacaatcagttttgtggtaataagactatattatcaatccaagccgcgtcgttctgtctttcgcacacaatggcacacactacttttttcactgtagaattaaaatcgaaagatacggctttataattgccgggagaagaaaattcctctgtatataccgttcctgtagacatatcctgtagcatgactttcaacttacatgctccttcggtctttacatcagcagagaagcgataagtcctgccactctccatgtcaaccctctgcatgagtcctgcatgaccagatatacaggctacattattgcctgcattgtcagtctgtacgcaaaccgtaccatagttacccaatggctgccatgctgaaagtccttcgctgaaggttccattctgcaaggtagagacagtatatttctcaacctgcagtatcatggacgatacgtgacctcctccgtcggaaaaggtgatgtcgacattattatcgccattcttcagcagctgtatgtcgaacggtacttctatcataccgaaaaatatattgcggttgctctggccgtagcctttccagttgtcgggaacactcacagcggtaccattaatctttaccaccggtttcttggaagcagagacaggacggcctatcgacatacgcaagctt

SEQ ID NO: 83 - DNA, 3524 bp, Artificial sequence
  Synthetic sequence
atatagccggagattctccgtccacttctatgtctatcatctcttcatgctcgcacgattcacttcttaacacatcagcaaacttttcatcctccccactgttggcagagatattctccgtaaccatgtccccctcagttatcataggaattacaacatggaaaacagtgcctttaccttcctctgatacaaacgtaatatttccattatgtatctctacaagccgcttggtcagaaacagacctataccggtacctccttcagcagagtttttattctgactgtagaaacgctcgaagaggtgtgttttcaggttgtcggatattccgtttcccgagtctgccacagagatgtttattttgttatcctgttcattgacagtaaacgatacaaatcctccggcaggagtatgcttaatggcattcgatacgagattatagattatctgttccataagatgagggtcgaacagaaagcttatatcactgcgtgagacagaatattccagccctacacctttctgttttgcccaatacgtgaactgctgaaatacttcttttgagaaagacgagaagttgccatatttgagattcagactaagcattcctttctcgctctttgagaagttcatcagctggttgacaagacttaacaggaacttactgttatgctccattgtctgcagcatgccggcaagatacttgtcggacgaatacttgcccgattcaataatcatactaagtggagaatgaataagtgtgagtggtgtcctcaattcatgcgatatgttggtaaaaaatgtagtctccttttcaagaagttcttcagtcttgcgtttttccatgtttgctatatatagagcatttctgcgctgcacccgtgaggtataatacaccttgaaccggtataaagacaagacaagcaatataaaatagagtgtataggcataccatgtacgccagaaaggagggttaataatgacaggtatggaaagttcattcaaactgtagactccatcgctattcctgaccctcagtctgaacatatattcgcctgaaggaagctttgtgtagaaagcctcacgatgaaaagcggaggtggaaatccatgaatcatctacgccttcgagcatatattcgtaaccaaccttataaggacttctgtaatccagggagctgaactggaatgagaaagtgtttaaattataaggcaattcaatgtgctctgtaaaacttacacttttgtcgaaataagctgaatatgtggaatctgcctcaacgctgtgattgaagattttaaaatcaacgagtgtaggactaccgttgaaatctatcacatcaaagtcattaggtctaaagacgttaattccgtttacgccaccgaatatcattgttccatccgtcattactccagcagaaagttccataaattcataatcctgaagaccatcgaaaatatcataagatcttattctctgtgtgttgatattcaacgaattaattcctttattggtagaaatccataatgttccatccgtgccattaacaattgattttattgtattgctgctcaacccgtctgcagagctaaaattttcaacgcaggcattatggttttcatccaaatccacgattttccttaacccacgtccaagtgttccataccagatattatgattcaagtcttcacatacaggcactatatagtcgagttcatcaagtcccttgactgagttcaaaacaggattatctatatacaaatctgcagattccaatactttaagaccgaagctggaagctacccatatattacccttatgatctttaatgatgtttcttactatcttaagttctttattgtcagatgttttgatttccttcatcacacctgtggacaaatcatatctgaaaagacctttattatatgtgccaatccacaaatattttccatcggcaagcattgcgcgcacatttctcaaacctgagatctttttataatcattatcagaagtgaaactgtaaataccatcgtacatcagagacacatacatgcagtcggtgtagtttgagtatgctgttgagtatactatcctgtttgccgtgaaaggaataagtctggcattaccggtaatggaattaaaatgatatagccctgagccttctgtgcctaaatatatatcagatttggcaaatgtataaacggacgatatatgatcatttcctattcctctgaataaatctataggtttattattttcgcgtatactcataaagccactcttgaaaaatcctatccaaagaatatcgtttttatcaagaactacagtttgcggatagctgtaagaatatgtagcaataacctgtggttttgactcgatggcatgcaatacatcaaaagtcaacacattcacagtgcttgtagtggcataaaataatcttttgtttttatataccatttttcgtatatcacagttttccaacagggtacttaccttgcaggtatgcttgtcgtataaacataattgatgattttccagatttgagtacaatatttgagaagatgagatgactatggctgaagctatagggcatcccaatagtttgttaagcagtaattcatctccatcgacgttacattcgtacaggccgtcttcggaggagagcattatcgtattatctatttctatgatgtcggaaatgtatggtaattttaatgttgatcttaagacagtatttattttgccattttgaaaatcataatttacaaggtatatactttcatcagaggaatgaaaccagactctgtctttagagtcgacaagaatcttatcgcaagtgaaatttttatcaataccgctgtgaccaagatttaatgaaacgaattcgttctttacagaattgaacaggaacactcctctatcggctgtacctatccacagatttccatgtgaatcttcgtcaatacatactatcagattactgttaagaccgtttgactgatatccgtaaaccttaaattcatatccgtcaaacctgttcagtccgtcgttcgtggccaaccatataaagccttttgagtcttgataaatacattgcacatcattttgggaaagtccatcaagagtagtgtactttcttgtgacaaactcattggatgcaaaggatttgcaaactataatcagaactgatattaaacttaagattaatctaaacatataactattattctttatatttcatcaagattacaaagttattgattttatctaaaacatcaagtatttacagtagttaatagataattatagatattttccactttagaatgcgtatcaaaatcaatcaagaaaaaaataaatctttaacttcatttcatagtataaaacaaaaaaagcatcgtaccattacactcaataatagatacgatgcccgaaagaaattacagtaacagactgtattgggattaacaaatactttcaggacgatgtaaagtcctgagaaatcaaactgaatggatagataaat

SEQ ID NO: 84 - DNA, 769 bp, Artificial sequence
  Synthetic sequence
aaacagcattccaggtattagaagaatatcctgattcaggtgaaaatattgttgatgcgctggcagtgttcctgcgccggttgcattcgattcctgtttgtaattgtccttttaacagcgatcgcgtatttcgtctagctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgccagaagagagaaagaaggaaagcggccgcacaggtttcccgactggaaagcgggcagtg

That which is claimed is:

1. A method of colonizing the gut of a subject with a genetically modified, non-naturally occurring Bacteroides cell, the method comprising administering to the subject both:
   a) the genetically modified Bacteroides cell, wherein the genetically modified Bacteroides cell comprises a heterologous carbohydrate-utilization gene set that provides the genetically modified Bacteroides cell with an ability to utilize as a carbon source a porphyran and the heterologous carbohydrate-utilization gene set comprises one or more nucleic acids, wherein said one or more nucleic acids encodes all of the following proteins: a protein that has 80% or more sequence identity to SEQ ID NO: 14, a protein that has 80% or more sequence identity to SEQ ID NO: 15, a protein that has 80% or more sequence identity to SEQ ID NO: 16, a protein that has 80% or more sequence identity to SEQ ID NO: 17, a protein that has 80% or more sequence identity to SEQ ID NO: 18, a protein that has 80% or more sequence identity to SEQ ID NO: 19, a protein that has 80% or more sequence identity to SEQ ID NO: 20, a protein that has 80% or more sequence identity to SEQ ID NO: 21, a protein that has 80% or more sequence identity to SEQ ID NO: 22, a protein that has 80% or more sequence identity to SEQ ID NO: 23, a protein that has 80% or more sequence identity to SEQ ID NO: 24, a protein that has 80% or more sequence identity to SEQ ID NO: 25, a protein that has 80% or more sequence identity to SEQ ID NO: 26, a protein that has 80% or more sequence identity to SEQ ID NO: 27, a protein that has 80% or more sequence identity to SEQ ID NO: 28, a protein that has 80% or more sequence identity to SEQ ID NO: 29, a protein that has 80% or more sequence identity to SEQ ID NO: 30, a protein that has 80% or more sequence identity to SEQ ID NO: 31, a protein that has 80% or more sequence identity to SEQ ID NO: 32, a protein that has 80% or more sequence identity to SEQ ID NO: 33, and a protein that has 80% or more sequence identity to SEQ ID NO: 34; and
   b) porphyran;
   wherein the genetically modified Bacteroides cell reaches an abundance of at least $10^7$ cells/mL in the feces of the subject.

2. The method of claim 1, wherein the genetically modified Bacteroides cell further comprises one or more therapeutic transgenes.

3. The method of claim 1, wherein the Bacteroides cell is not a B. plebeius cell or a B. ovatus cell.

4. The method of claim 1, wherein the carbohydrate-utilization gene set is at least 40 kb.

5. The method of claim 1, wherein the carbohydrate-utilization gene set is encoded on a plasmid, encoded on a bacterial artificial chromosome, or artificially genomically integrated.

6. The method of claim 5, wherein the carbohydrate-utilization gene set is artificially genomically integrated.

7. The method of claim 1, wherein the genetically modified Bacteroides cell and porphyran are administered orally.

8. The method of claim 1, wherein said one or more nucleic acids encodes all of the following proteins: a protein that has 90% or more sequence identity to SEQ ID NO: 14, a protein that has 90% or more sequence identity to SEQ ID NO: 15, a protein that has 90% or more sequence identity to SEQ ID NO: 16, a protein that has 90% or more sequence identity to SEQ ID NO: 17, a protein that has 90% or more sequence identity to SEQ ID NO: 18, a protein that has 90% or more sequence identity to SEQ ID NO: 19, a protein that has 90% or more sequence identity to SEQ ID NO: 20, a protein that has 90% or more sequence identity to SEQ ID NO: 21, a protein that has 90% or more sequence identity to SEQ ID NO: 22, a protein that has 90% or more sequence identity to SEQ ID NO: 23, a protein that has 90% or more sequence identity to SEQ ID NO: 24, a protein that has 90% or more sequence identity to SEQ ID NO: 25, a protein that has 90% or more sequence identity to SEQ ID NO: 26, a protein that has 90% or more sequence identity to SEQ ID NO: 27, a protein that has 90% or more sequence identity to SEQ ID NO: 28, a protein that has 90% or more sequence identity to SEQ ID NO: 29, a protein that has 90% or more sequence identity to SEQ ID NO: 30, a protein that has 90% or more sequence identity to SEQ ID NO: 31, a protein that has 90% or more sequence identity to SEQ ID NO: 32, a protein that has 90% or more sequence identity to SEQ ID NO: 33, and a protein that has 90% or more sequence identity to SEQ ID NO: 34.

9. The method of claim 1, wherein said one or more nucleic acids encodes all of the following proteins: a protein that has 95% or more sequence identity to SEQ ID NO: 14, a protein that has 95% or more sequence identity to SEQ ID NO: 15, a protein that has 95% or more sequence identity to SEQ ID NO: 16, a protein that has 95% or more sequence identity to SEQ ID NO: 17, a protein that has 95% or more sequence identity to SEQ ID NO: 18, a protein that has 95% or more sequence identity to SEQ ID NO: 19, a protein that has 95% or more sequence identity to SEQ ID NO: 20, a protein that has 95% or more sequence identity to SEQ ID NO: 21, a protein that has 95% or more sequence identity to SEQ ID NO: 22, a protein that has 95% or more sequence identity to SEQ ID NO: 23, a protein that has 95% or more sequence identity to SEQ ID NO: 24, a protein that has 95% or more sequence identity to SEQ ID NO: 25, a protein that has 95% or more sequence identity to SEQ ID NO: 26, a protein that has 95% or more sequence identity to SEQ ID NO: 27, a protein that has 95% or more sequence identity to SEQ ID NO: 28, a protein that has 95% or more sequence identity to SEQ ID NO: 29, a protein that has 95% or more sequence identity to SEQ ID NO: 30, a protein that has 95% or more sequence identity to SEQ ID NO: 31, a protein that has 95% or more sequence identity to SEQ ID NO: 32, a protein that has 95% or more sequence identity to SEQ ID NO: 33, and a protein that has 95% or more sequence identity to SEQ ID NO: 34.

10. The method of claim 1, wherein said one or more nucleic acids encodes all of the proteins set forth in SEQ ID NOs: 14-34.

11. The method of claim 1, wherein the genetically modified *Bacteroides* cell reaches an abundance of at east $10^7$ cells/mL in the feces of the subject for at least 7 days.

12. The method of claim 1, wherein the genetically modified *Bacteroides* cell reaches an abundance of at least $10^8$ cells/mL in the feces of the subject.

13. The method of claim 12, wherein the genetically modified *Bacteroides* cell reaches an abundance of at least $10^8$ cells/mL in the feces of the subject for at least 3 days.

14. A method of colonizing the gut of a subject with a genetically modified, non-naturally occurring *Bacteroides* cell, the method comprising orally administering to the subject both:
 a) the genetically modified *Bacteroides* cell, wherein the genetically modified *Bacteroides* cell comprises a heterologous carbohydrate-utilization gene set that (i) provides the genetically modified *Bacteroides* cell with an ability to utilize as a carbon source a porphyran, (ii) is at least 40 kb, (iii) is encoded on a plasmid, encoded on a bacterial artificial chromosome, or artificially genomically integrated, and (iv) comprises one or more nucleic acids, wherein said one or more nucleic acids encodes all of the following proteins: a protein that has 80% or more sequence identity to SEQ ID NO: 14, a protein that has 80% or more sequence identity to SEQ ID NO: 15, a protein that has 80% or more sequence identity to SEQ ID NO: 16, a protein that has 80% or more sequence identity to SEQ ID NO: 17, a protein that has 80% or more sequence identity to SEQ ID NO: 18, a protein that has 80% or more sequence identity to SEQ ID NO: 19, a protein that has 80% or more sequence identity to SEQ ID NO: 20, a protein that has 80% or more sequence identity to SEQ ID NO: 21, a protein that has 80% or more sequence identity to SEQ ID NO: 22, a protein that has 80% or more sequence identity to SEQ ID NO: 23, a protein that has 80% or more sequence identity to SEQ ID NO: 24, a protein that has 80% or more sequence identity to SEQ ID NO: 25, a protein that has 80% or more sequence identity to SEQ ID NO: 26, a protein that has 80% or more sequence identity to SEQ ID NO: 27, a protein that has 80% or more sequence identity to SEQ ID NO: 28, a protein that has 80% or more sequence identity to SEQ ID NO: 29, a protein that has 80% or more sequence identity to SEQ ID NO: 30, a protein that has 80% or more sequence identity to SEQ ID NO: 31, a protein that has 80% or more sequence identity to SEQ ID NO: 32, a protein that has 80% or more sequence identity to SEQ ID NO: 33, and a protein that has 80% or more sequence identity to SEQ ID NO: 34; and
 b) porphyran;
 wherein the genetically modified *Bacteroides* cell reaches an abundance of at least $10^7$ cells/mL in the feces of the subject.

15. The method of claim 14, wherein the genetically modified *Bacteroides* cell further comprises one or more therapeutic transgenes.

16. The method of claim 14, wherein the *Bacteroides* cell is not a *B. plebeius* cell or a *B. ovatus* cell.

17. The method of claim 14, wherein the carbohydrate-utilization gene set is artificially genomically integrated.

18. The method of claim 14, wherein said one or more nucleic acids encodes all of the following proteins: a protein that has 90% or more sequence identity to SEQ ID NO: 14, a protein that has 90% or more sequence identity to SEQ ID NO: 15, a protein that has 90% or more sequence identity to SEQ ID NO: 16, a protein that has 90% or more sequence identity to SEQ ID NO: 17, a protein that has 90% or more sequence identity to SEQ ID NO: 18, a protein that has 90% or more sequence identity to SEQ ID NO: 19, a protein that has 90% or more sequence identity to SEQ ID NO: 20, a protein that has 90% or more sequence identity to SEQ ID NO: 21, a protein that has 90% or more sequence identity to SEQ ID NO: 22, a protein that has 90% or more sequence identity to SEQ ID NO: 23, a protein that has 90% or more sequence identity to SEQ ID NO: 24, a protein that has 90% or more sequence identity to SEQ ID NO: 25, a protein that has 90% or more sequence identity to SEQ ID NO: 26, a protein that has 90% or more sequence identity to SEQ ID NO: 27, a protein that has 90% or more sequence identity to SEQ ID NO: 28, a protein that has 90% or more sequence identity to SEQ ID NO: 29, a protein that has 90% or more sequence identity to SEQ ID NO: 30, a protein that has 90% or more sequence identity to SEQ ID NO: 31, a protein that has 90% or more sequence identity to SEQ ID NO: 32, a protein that has 90% or more sequence identity to SEQ ID NO: 33, and a protein that has 90% or more sequence identity to SEQ ID NO: 34.

19. The method of claim 14, wherein said one or more nucleic acids encodes all of the following proteins: a protein that has 95% or more sequence identity to SEQ ID NO: 14, a protein that has 95% or more sequence identity to SEQ ID NO: 15, a protein that has 95% or more sequence identity to SEQ ID NO: 16, a protein that has 95% or more sequence identity to SEQ ID NO: 17, a protein that has 95% or more sequence identity to SEQ ID NO: 18, a protein that has 95% or more sequence identity to SEQ ID NO: 19, a protein that has 95% or more sequence identity to SEQ ID NO: 20, a protein that has 95% or more sequence identity to SEQ ID NO: 21, a protein that has 95% or more sequence identity to SEQ ID NO: 22, a protein that has 95% or more sequence identity to SEQ ID NO: 23, a protein that has 95% or more sequence identity to SEQ ID NO: 24, a protein that has 95% or more sequence identity to SEQ ID NO: 25, a protein that has 95% or more sequence identity to SEQ ID NO: 26, a protein that has 95% or more sequence identity to SEQ ID NO: 27, a protein that has 95% or more sequence identity to SEQ ID NO: 28, a protein that has 95% or more sequence identity to SEQ ID NO: 29, a protein that has 95% or more sequence identity to SEQ ID NO: 30, a protein that has 95% or more sequence identity to SEQ ID NO: 31, a protein that has 95% or more sequence identity to SEQ ID NO: 32, a protein that has 95% or more sequence identity to SEQ ID NO: 33, and a protein that has 95% or more sequence identity to SEQ ID NO: 34.

20. The method of claim 14, wherein said one or more nucleic acids encodes all of the proteins set forth in SEQ ID NOs: 14-34.

* * * * *